US009637736B2

(12) United States Patent
Flasinski et al.

(10) Patent No.: US 9,637,736 B2
(45) Date of Patent: May 2, 2017

(54) PLANT REGULATORY ELEMENTS AND USES THEREOF

(75) Inventors: Stanislaw Flasinski, Chesterfield, MO (US); Charles R. Dietrich, Chesterfield, MO (US); Wei Wu, St. Louis, MO (US); Zhaolong Li, St. Louis, MO (US); Bo-Xing Qiu, Chesterfield, MO (US); Liang Guo, Cary, NC (US); Jaishree M. Chittoor, Wildwood, MO (US)

(73) Assignee: Monsanto Technology LLC, St. Louis, MO (US)

( * ) Notice: Subject to any disclaimer, the term of this patent is extended or adjusted under 35 U.S.C. 154(b) by 648 days.

(21) Appl. No.: 13/520,780

(22) PCT Filed: Jan. 14, 2011

(86) PCT No.: PCT/US2011/021269
§ 371 (c)(1),
(2), (4) Date: Oct. 18, 2012

(87) PCT Pub. No.: WO2011/088299
PCT Pub. Date: Jul. 21, 2011

(65) Prior Publication Data
US 2013/0031672 A1 Jan. 31, 2013

Related U.S. Application Data

(60) Provisional application No. 61/295,160, filed on Jan. 14, 2010, provisional application No. 61/295,162, filed on Jan. 14, 2010, provisional application No. 61/339,057, filed on Feb. 26, 2010, provisional application No. 61/308,919, filed on Feb. 27, 2010, provisional application No. 61/308,921, filed on Feb. 27, 2010, provisional application No. 61/331,924, filed on May 6, 2010.

(51) Int. Cl.
*C12N 15/113* (2010.01)
*C12N 15/82* (2006.01)
(52) U.S. Cl.
CPC ........ *C12N 15/113* (2013.01); *C12N 15/8222* (2013.01)
(58) Field of Classification Search
None
See application file for complete search history.

(56) References Cited

U.S. PATENT DOCUMENTS

| | | | |
|---|---|---|---|
| 6,462,258 B1 * | 10/2002 | Fincher et al. | 800/300 |
| 6,603,061 B1 | 8/2003 | Armstrong et al. | |
| 7,151,204 B2 * | 12/2006 | Houmard et al. | 800/278 |
| 7,888,553 B2 | 2/2011 | Dixon et al. | |
| 8,138,392 B2 | 3/2012 | Uppalapati et al. | |
| 2004/0049802 A1 | 3/2004 | Dixon et al. | |
| 2006/0162020 A1 * | 7/2006 | Sauer et al. | 800/282 |
| 2010/0081179 A1 * | 4/2010 | Anthony | C12N 9/88 435/135 |
| 2011/0107468 A1 | 5/2011 | Flasinski et al. | |

FOREIGN PATENT DOCUMENTS

| | | | |
|---|---|---|---|
| EP | 0633317 | 1/1995 | |
| WO | WO 99/09188 | 2/1999 | |
| WO | WO 00/06752 | 2/2000 | |
| WO | WO 2006/084868 | 8/2006 | |
| WO | WO2007/091634 | * 8/2007 | C12N 15/29 |
| WO | WO 2009/073844 | 6/2009 | |

OTHER PUBLICATIONS

An et al. Functional analysis of the 3' control region of the potato wound-inducible proteinase inhibitor II gene. The Plant Cell. 1989. 1: 115-122.*
Doust et al. Foxtail Millet: A sequence-derived grass model system. Plant Physiology. 2009. 149: 137-141.*
Marchler-Bauer et al. CD-Search: protein domain annotations on the fly. Nucleic Acids Res. 2004(32(W)): 327-331.*
NCBI Trace Archive ti: 2168184508; trace name: FZGA66461.b1; load date: Nov. 26, 2008.
NCBI Trace Archive ti: 2169898051; trace name: FZGB240059.g1; load date: Nov. 27, 2008.
NCBI Trace Archive ti: 2168071963; trace name: FZGA28378.g1; load date: Nov. 26, 2008.
Li et al., "Secondary xylem-specific expression of caffeoyl-coenzyme A 3-O-methyltransferase plays an important role in the methylation pathway associated with lignin biosynthesis in loblolly pine," *Plant Molec. Biol.*, 40(4):555-565, Jul. 1999.
Veeranagamallaiah et al., "Proteomic analysis of salt stress responses in foxtail millet (*Setaria italica* L. cv. Prasad) seedlings," *Plant Science*, 175(5):631-641, Nov. 2008.
International Search Report and Written Opinion dated Jun. 21, 2011 in PCT International Patent Application No. PCT/US2011/021269, filed Jan. 14, 2011.
Notice of Allowance issued in U.S. Appl. No. 12/935,272, Jul. 12, 2013.
European Office Action regarding Application No. 15184291, dated Dec. 18, 2015.
Lau et al., "Sequence and In Silico Characterization of the Tomato Polygalacturonase (PG) Promoter and Terminator Regions," *Plant Mol. Biol. Rep.* 27:250-256, 2009.
Nagaya et al., "The *HSP* Terminator of *Arabidopsis thaliana* Increases Gene Expression in Plant Cells," *Plant Cell Physiol.* 51(2):328-332, 2010.
Outchkourov et al., "The promoter-terminator of chrysanthemum rbcS1 directs very high expression levels in plants," *Planta* 216:1003-1012, 2003.

* cited by examiner

*Primary Examiner* — Ashley K Buran
(74) *Attorney, Agent, or Firm* — Dentons US LLP; Carine M. Doyle Esq.

(57) ABSTRACT

The invention provides DNA molecules and constructs, and their nucleotide sequences, useful for modulating gene expression in plants, and for specifying intracellular or extracellular localization of a gene product of interest. Transgenic plants, plant cells, plant parts, and seeds, comprising the DNA molecules operably linked to heterologous transcribable polynucleotides are also provided.

10 Claims, 59 Drawing Sheets

```
P-SETit.Act8-1:1:5      TGTGCCATACCCGAGTGGCCATTATATAAATGTAAACTTGATTGACGAAATAATTCAGGC
P-SETit.Act8-1:1:6      ------------------------------------------------------------

P-SETit.Act8-1:1:5      ACAAGCTGGAAAAATATATTAAATTTTTTTCGATCAATCAGGGCATCAGTACAAAA
P-SETit.Act8-1:1:6      ------------------------------------------------------------

P-SETit.Act8-1:1:5      GCTGGACAGTGTGATCGAAAAGGCAACACCCTGGAATGGGGGTGTTCGGTTGGGTGAG
P-SETit.Act8-1:1:6      ------------------------------------------------------------

P-SETit.Act8-1:1:5      CGCAGCAGGCCCAAAAGCCGACCCAAGCAACATCCAGCGAAGAACCAGTTGGACTTGGAC
P-SETit.Act8-1:1:6      ------------------------------------------------------------

P-SETit.Act8-1:1:5      CGACCCGATTGGCGGGCGCGCACGTACTGATGCTGCGGGGCCCACTAGGCAGATCGGACGG
P-SETit.Act8-1:1:6      ------------------------------------------------------------

P-SETit.Act8-1:1:5      CGGGTGCGTCCTCCGCGTCGCCCATCGTGCGGTCCAGGTTGTCTCAGCATCTCCAGCTCA
P-SETit.Act8-1:1:6      ------------------------------------------------------------

P-SETit.Act8-1:1:5      TTCCAGCCTCAGGCGGCTCTTGGGGGCCCTCTATTTATTTCTCTCCTTTTTCGAC
P-SETit.Act8-1:1:6      ------------------------------------------------------------

P-SETit.Act8-1:1:5      TCGCTCTCATTTTCTCCATTTCTTTTCTTTGGTCCCGACCACAGGTACTTCCAGTGG
P-SETit.Act8-1:1:6      ------------------------------------------------------------

P-SETit.Act8-1:1:5      AAGGAATATAATTGTAGTTTTCTATTGTGTAAATAGCATTGTCTCTGATACACAATAGAC
P-SETit.Act8-1:1:6      ---------------------------------ATTGTCTGATACACAATAGAC
                                                         *********************

P-SETit.Act8-1:1:5      ATGAAATACCTTGGTGCCAGGGTTCTCACTCTCTTCTCGGTTATGTTGTTTGATTCTTGATCC
P-SETit.Act8-1:1:6      ATGAAATACCTTGGTGCCAGGGTTCTCACTCTCTTCTCGGTTATGTTGTTTGATTCTTGATCC
                        **************************************************************
```

FIG. 1a

```
P-SETit.Act8-1:1:5    AAACTCAAGATGCTGAACTGAAATCATAAAATTTCATCCTTTACAAATTACCCTAAAGGA
P-SETit.Act8-1:1:6    AAACTCAAGATGCTGAACTGAAATCATAAAATTTCATCCTTTACAAATTACCCTAAAGGA
                      ************************************************************

P-SETit.Act8-1:1:5    GTTGTTTTCATTTGCCTTCAATTAAAGTTCTTCGCCTTCAACGGTGTGGTTGTTGGAA
P-SETit.Act8-1:1:6    GTTGTTTTCATTTGCCTTCAATTAAAGTTCTTCGCCTTCAACGGTGTGGTTGTTGGAA
                      **********************************************************

P-SETit.Act8-1:1:5    GTTAGAAGCATTGGCTTCGTGGCATGGACCTACTTGCAAATAATTCCTCCCAATTAAAA
P-SETit.Act8-1:1:6    GTTAGAAGCATTGGCTTCGTGGCATGGACCTACTTGCAAATAATTCCTCCCAATTAAAA
                      **********************************************************

P-SETit.Act8-1:1:5    GTTTTTTTTGCAAATAATGCCTCTTTTGATGCCATCGCCTTTTCTAGCCCGTGACAACC
P-SETit.Act8-1:1:6    GTTTTTTTTGCAAATAATGCCTCTTTTGATGCCATCGCCTTTTCTAGCCCGTGACAACC
                      **********************************************************

P-SETit.Act8-1:1:5    GGAGTTCAGGAGAGATGCATAAACTGTCTTTGAGATCCCCTTTTATTTTATTTTGATTG
P-SETit.Act8-1:1:6    GGAGTTCAGGAGAGATGCATAAACTGTCTTTGAGATCCCCTTTTATTTTATTTTGATTG
                      **********************************************************

P-SETit.Act8-1:1:5    CAAACTAATTTTAGTTGGCACTAGCCAGGATGGGCTAAATAATTCTTGAGATGTTGGCCT
P-SETit.Act8-1:1:6    CAAACTAATTTTAGTTGGCACTAGCCAGGATGGGCTAAATAATTCTTGAGATGTTGGCCT
                      ************************************************************

P-SETit.Act8-1:1:5    AAATAATTTTCAGAAAATGAAGTGTCCTCCACGTCTCCATGACAAAAAAAATACTCCAT
P-SETit.Act8-1:1:6    AAATAATTTTCAGAAAATGAAGTGTCCTCCACGTCTCCATGACAAAAAAAATACTCCAT
                      **********************************************************

P-SETit.Act8-1:1:5    GTTGGACTACAGTCTAAAAAGAACAGAGCTGTAACATGATGATTAAAAAAAGAAGAA
P-SETit.Act8-1:1:6    GTTGGACTACAGTCTAAAAAGAACAGAGCTGTAACATGATGATTAAAAAAAGAAGAA
                      **********************************************************

P-SETit.Act8-1:1:5    CATTTGAGACCTCTGTTTCATGCTGAAATTATACCTTGTTTTTCCATTCTTGTTACCG
P-SETit.Act8-1:1:6    CATTTGAGACCTCTGTTTCATGCTGAAATTATACCTTGTTTTTCCATTCTTGTTACCG
                      **********************************************************
```

FIG. 1b

```
P-SETit.Act8-1:1:5   TGGTCAAAAGGAAATGTTAGATACTAACTGATAACTGAAAAATAGATGCATATCCTTAAA
P-SETit.Act8-1:1:6   TGGTCAAAAGGAAATGTTAGATACTAACTGATAACTGAAAAATAGATGCATATCCTTAAA
                     ************************************************************

P-SETit.Act8-1:1:5   AAAGATCTCCATTTGGAAAAAATATGATAAACACGAAATTCGTAGACGCCGAACATCTGA
P-SETit.Act8-1:1:6   AAAGATCTCCATTTGGAAAAAATATGATAAACACGAAATTCGTAGACGCCGAACATCTGA
                     ************************************************************

P-SETit.Act8-1:1:5   AATATTATTCAATTTTTTGGGGAAAAAAATACACGCCTCGTATTTCAAACCGTATCTGT
P-SETit.Act8-1:1:6   AATATTATTCAATTTTTTGGGGAAAAAAATACACGCCTCGTATTTCAAACCGTATCTGT
                     ***********************************************************

P-SETit.Act8-1:1:5   GTCACGGACCACGCCATCAATCGAGTCCACGTACCACCACCCATCCCCTTCCCCCTTCCCC
P-SETit.Act8-1:1:6   GTCACGGACCACGCCATCAATCGAGTCCACGTACCACCACCCATCCCCTTCCCCCTTCCCC
                     ************************************************************

P-SETit.Act8-1:1:5   CCCGCTCTTGTATAAACTCCACCACCCCAGTCCTCGGGG
P-SETit.Act8-1:1:6   CCCGCTCTTGTATAAACTCCACCACCCCAGTCCTCGGGG
                     ***************************************
```

FIG. 1c

```
P-SETit.Alc1-1:1:1   CAATCATTGCCACTGAAATCCCTGAGTATAACATAGTTCTCACGAAGAAGGCCAAAGTTG
P-SETit.Alc1-1:1:2   ------------------------------------------------------------

P-SETit.Alc1-1:1:1   AGCCCAAAATTTTCGATAAAGTCGTTACATCTTATTTCGTACTTATATCATCTTTACAC
P-SETit.Alc1-1:1:2   ------------------------------------------------------------

P-SETit.Alc1-1:1:1   ACATGATCAATATTTTTTCTAGCAAAAAGTCATGCATGCTTCCATATACAGTGAAGATA
P-SETit.Alc1-1:1:2   ------------------------------------------------------------

P-SETit.Alc1-1:1:1   TGGGCATGGATAAATCCTAGGAACGCAAAAAAAAATTGACCTTGCTATGGCCCACGACT
P-SETit.Alc1-1:1:2   ------------------------------------------------------------

P-SETit.Alc1-1:1:1   TCTTGATTCTACCAATTTGACGCATGAAACCTCTCAAGAATGGACATAAATTTTTGGC
P-SETit.Alc1-1:1:2   ------------------------------------------------------------

P-SETit.Alc1-1:1:1   AAAAAGGTTCAACCCAAGTATATAACATAACACGTATCACAATAGTCTACGTTGCTA
P-SETit.Alc1-1:1:2   ------------------------------------------------------------

P-SETit.Alc1-1:1:1   GCATGATGGGAACAATACATGCTCATAAACCAAACATCATTGTTTAAAATTTTTGGTT
P-SETit.Alc1-1:1:2   ------------------------------------------------------------

P-SETit.Alc1-1:1:1   ACATGTTTGATTCACATGTTGCCCGTAAAATGGTGCTGATGAGCTTAGACGAAGGACTCAT
P-SETit.Alc1-1:1:2   ------------------------------------------------------------

P-SETit.Alc1-1:1:1   TGCGCTTCCTGTTATCTTGTGCAAACATCTCAAAAGTCATTATTCAAATTCATAAAGTGA
P-SETit.Alc1-1:1:2   ------------------------------------------------------------

P-SETit.Alc1-1:1:1   ACGATACAACACTTTTAACCGGCGTAATAGTTTAATAGAGGTAGCCGTATAGGGTCGGAAT
P-SETit.Alc1-1:1:2   ------------------------------------------------------------
```

FIG. 2a

```
P-SETit.Alc1-1:1:1   ATCATCTTCTTTGTAGCCATAGGCATGTCGCACCCAAGAATTGAATGGAAATATGATACC
P-SETit.Alc1-1:1:2   ------------------------------------------------------------

P-SETit.Alc1-1:1:1   GTTAAGTTGAGCGCCCAGTGTCTCATGTTGTTGTGCACCGATGAAATTGGTTCCTGAGTAT
P-SETit.Alc1-1:1:2   ------------------------------------------------------------

P-SETit.Alc1-1:1:1   ATATGGAAAACAAAAGAGTCTAGGTTTTAATCCGATCCATTGTTACCACACATCCAGAAA
P-SETit.Alc1-1:1:2   ------------------------------------------------------------

P-SETit.Alc1-1:1:1   CACTATCTTCAACTTTTCATAGAAATATTATGCAAAAGCAGGAAGAAAAACTTCCTATGG
P-SETit.Alc1-1:1:2   ------------------------------------------------------------

P-SETit.Alc1-1:1:1   ATCGATATAGATGGCCCTACAATATGTATCTGTAGACAAGGTAGAATACATTCAAATATG
P-SETit.Alc1-1:1:2   ------------------------------------------------------------

P-SETit.Alc1-1:1:1   TCAAAAGTAGAATCTTGGGAAACTACAATGTGCACAAGCAGCGGTCCTCCCACTTTGAGC
P-SETit.Alc1-1:1:2   ------------------------------------------------------------

P-SETit.Alc1-1:1:1   GACTTTCACCTTTAGAGAGATAGCTCTAACATATGCATGCGTAGATCTGGTGCAATATAT
P-SETit.Alc1-1:1:2   ------------------------------------------------------------

P-SETit.Alc1-1:1:1   CCACACCGATTGCAAACGGATTCCACGCAACCACCACGCAAACACCTTGTTGCGTGACT
P-SETit.Alc1-1:1:2   ------------------------------------------------------------

P-SETit.Alc1-1:1:1   TACAATACTGACTTAATCTAGGTTCTTGTGTATTGGCTCATTACTTACTTGATAACTTCT
P-SETit.Alc1-1:1:2   ------------------------------------------------------------

P-SETit.Alc1-1:1:1   TCTAGAACTAGTGCGTTACCTCTATCATCCATGAGGATTGGCTCATGAACAAATCCTAT
P-SETit.Alc1-1:1:2   ------------CATCCATGAGGATTGGCTCATGAACAAATCCTAT
                                 **********************************
```

FIG. 2b

```
P-SETit.Alc1-1:1:1    CCGAGTCAGATGAACAATGAAGCTCAAAAATGATTTGGATCCACATCAGCAAATCACAGCT
P-SETit.Alc1-1:1:2    CCGAGTCAGATGAACAATGAAGCTCAAAAATGATTTGGATCCACATCAGCAAATCACAGCT
                      ************************************************************

P-SETit.Alc1-1:1:1    TTACAAACCAACTTTAACAAAGTGGAACACACATATTTTTGTGGCTAAGACTTTCACGTGTT
P-SETit.Alc1-1:1:2    TTACAAACCAACTTTAACAAAGTGGAACACACATATTTTTGTGGCTAAGACTTTCACGTGTT
                      ************************************************************

P-SETit.Alc1-1:1:1    TAAAGGTGAACCGACCATGATGTTGTCACAAAGACAATACCAACAGAAGAAGACACTTTT
P-SETit.Alc1-1:1:2    TAAAGGTGAACCGACCATGATGTTGTCACAAAGACAATACCAACAGAAGAAGACACTTTT
                      ************************************************************

P-SETit.Alc1-1:1:1    TTGCTTGTACAACGGCAAGTTGTCTTGCCAACACATTACAACACAAGGGTATTTAT
P-SETit.Alc1-1:1:2    TTGCTTGTACAACGGCAAGTTGTCTTGCCAACACATTACAACACAAGGGTATTTAT
                      ************************************************************

P-SETit.Alc1-1:1:1    CACTAAATGCCAAAATTGACTAGATACCATGTCATCTCCAGTTTATCAAGCTAGCGATTT
P-SETit.Alc1-1:1:2    CACTAAATGCCAAAATTGACTAGATACCATGTCATCTCCAGTTTATCAAGCTAGCGATTT
                      ************************************************************

P-SETit.Alc1-1:1:1    GCAAGGCACAAGCAAAAATCTTGCTAAAGCTACATGAGCTCTCATGCCTATAAATACGCC
P-SETit.Alc1-1:1:2    GCAAGGCACAAGCAAAAATCTTGCTAAAGCTACATGAGCTCTCATGCCTATAAATACGCC
                      ************************************************************

P-SETit.Alc1-1:1:1    CCAAATGTTGTGTAGGT
P-SETit.Alc1-1:1:2    CCAAATGTTGTGTAGGT
                      *****************
```

FIG. 2c

```
P-SETit.Cys1:1:2    GGTGGGTTAATCTTTATGGGTAGTTTAGTGTGTTGGCTTGCAACTTTATCATGAAAATAGT
P-SETit.Cys1:1:3    ------------------------------------------------------------

P-SETit.Cys1:1:2    TGTATAGTCACTTGTTGGCTTGCAACTTTATCATGAAGGAAAGTTGTATAGTCATGTGTT
P-SETit.Cys1:1:3    ------------------------------------------------------------

P-SETit.Cys1:1:2    CAAAAGTTTGCATCTCTAACCCCTGCATGTACTAAATCGTAGACACTGAAGCTCCAAAAG
P-SETit.Cys1:1:3    ------------------------------------------------------------

P-SETit.Cys1:1:2    TGGAATTCTTGGATTTCTCTGAAGAACCTTCGGAGTTTGAGGAGATTTTGAGTTGATCC
P-SETit.Cys1:1:3    ------------------------------------------------------------

P-SETit.Cys1:1:2    CCTGTGAAGCCGGACCTTCGGACAACACTAACCTTTTTACAGATCAAGGCAAGCCCCGGT
P-SETit.Cys1:1:3    ------------------------------------------------------------

P-SETit.Cys1:1:2    GCATCTATACCTACCTACTTTGGAGTTATTATTTCATGTGTTCAATTGTTGGTTATTTTC
P-SETit.Cys1:1:3    ------------------------------------------------------------

P-SETit.Cys1:1:2    CGTATGAATGCATTAAGTCTAGGAGTTGATTGAAACCTATTCTGTTCATGATCCTACCT
P-SETit.Cys1:1:3    ------------------------------------------------------------

P-SETit.Cys1:1:2    GATTTAGAGGACATCTTTGCCACTTGTTCACTAATTAGTAACTATCCTATGCTTAGCAAT
P-SETit.Cys1:1:3    ------------------------------------------------------------

P-SETit.Cys1:1:2    GCTTAGATACTTCAAGCAACTTGGATTGCTTAGCTCTAAGGAAAATTTTGGTCATACATG
P-SETit.Cys1:1:3    ------------------------------------------------------------

P-SETit.Cys1:1:2    TTAGTTAAGGAAAAAATAGCCTGGAAATTGGAAATGCAGACAGAAGCTAGAGATGGTAGTT
P-SETit.Cys1:1:3    ------------------------------------------------------------

P-SETit.Cys1:1:2    CTGTTTGCTAAGTTAATTGGTTAAGGCCCGATCGTTGTCTTAACCTTTGATCAAGTGAG
P-SETit.Cys1:1:3    ------------------------------------------------------------
```

FIG. 3a

```
P-SETit.Cys-1:1:2    TTCTACCTGGTTGCTTACTGGGTATGGGACCAGTAAAGCCCGGTAGGTTAGTTGGCTCTT
P-SETit.Cys-1:1:3    ------------------------------------------------------------

P-SETit.Cys-1:1:2    TGATCGGGAATATTCGTACCCGTGCTTGACGTGCTGGAGAATGGTAGGGCATAGCCTG
P-SETit.Cys-1:1:3    ----------------------------------------------------------

P-SETit.Cys-1:1:2    AAACTCACATGGAGATCAGGCCAGACGTGGGGTCCCATGTGGGGTGCGTCCCTGGGTTCG
P-SETit.Cys-1:1:3    ------------------------------------------------------------

P-SETit.Cys-1:1:2    GGTAGTCATGTTCCCAATTTTTGGGTACGGCTAATAGAAAGGTCATTATATGCAACCTAG
P-SETit.Cys-1:1:3    ------------------------------------------------------------

P-SETit.Cys-1:1:2    ACAGTTGTACATAGCTGGTGGTTGGGTATCTCCTGCAGGATGTAAATTGATCCGGATCGC
P-SETit.Cys-1:1:3    ------------------------------------------------------------

P-SETit.Cys-1:1:2    CGCAATTCTCGGATATGAATGCACTTGATCACCGTTAAGCATCATACTGTAATCCAGTTG
P-SETit.Cys-1:1:3    ------------------------------------------------------------

P-SETit.Cys-1:1:2    AATATAATGTTTTTCCTAGAATGAATATGCTGTATGACTTAGTTCCACTGAGTGCTCAAA
P-SETit.Cys-1:1:3    ------------------------------------------------------------

P-SETit.Cys-1:1:2    ATGTTTTATTCATCTAGACTGGTTAGGTAACAACTAAACAAAAATAAAAGAATAAAGTTA
P-SETit.Cys-1:1:3    ------------------------------------------------------------

P-SETit.Cys-1:1:2    AGGTTCCACTTATAGTAAGCCTTTCCCGCAAAAATGTGAGTCCGCGCCAGTATACTAAACAGC
P-SETit.Cys-1:1:3    --------------------------------------------------------------

P-SETit.Cys-1:1:2    TATCATTCAGTTTTTGGAAAAAAAAACTATCTATATTGGTTAATCGGGTCAGTCTTGCT
P-SETit.Cys-1:1:3    ---------------------------------------------------------GCT
                                                                              ***

P-SETit.Cys-1:1:2    AAGTACCCTCGGACTCAGGGGAATCCTTCGTTGCTATTCAGAACTACAGCAAGAGTCCG
P-SETit.Cys-1:1:3    AAGTACCCTCGGACTCAGGGGAATCCTTCGTTGCTATTCAGAACTACAGCAAGAGTCCG
                     ************************************************************
```

FIG. 3b

| | |
|---|---|
| P-SETit.Cys-1:1:2 | CCGAGGGAGAAGCCCCGAAGAATTAGGGTATTTTACGAGTCTCATAATACCCTAGAAAT |
| P-SETit.Cys-1:1:3 | CCGAGGGAGAAGCCCCGAAGAATTAGGGTATTTTACGAGTCTCATAATACCCTAGAAAT |
| | ********************************************************** |
| P-SETit.Cys-1:1:2 | AAAACTCAGATGTTTAACTTTCACCTGACTAGTTTATGTTTTAAACTCTTAGAACTGTT |
| P-SETit.Cys-1:1:3 | AAAACTCAGATGTTTAACTTTCACCTGACTAGTTTATGTTTTAAACTCTTAGAACTGTT |
| | ********************************************************** |
| P-SETit.Cys-1:1:2 | CTGACCTGCATTGTTAAGTTTGTTCAAATTATGGTTGTAATAATTCGCACCTCGATATG |
| P-SETit.Cys-1:1:3 | CTGACCTGCATTGTTAAGTTTGTTCAAATTATGGTTGTAATAATTCGCACCTCGATATG |
| | ********************************************************** |
| P-SETit.Cys-1:1:2 | TATGTAAAAATGTAATATTTGTTGATACCTTCCCATCGTGGAAGTGATCCTGATGTATGG |
| P-SETit.Cys-1:1:3 | TATGTAAAAATGTAATATTTGTTGATACCTTCCCATCGTGGAAGTGATCCTGATGTATGG |
| | ********************************************************** |
| P-SETit.Cys-1:1:2 | CTATGGATCACGTCGTGGATGTTTCGAGGAGTCCTAAGGACACTCGACGGAATACCGGAC |
| P-SETit.Cys-1:1:3 | CTATGGATCACGTCGTGGATGTTTCGAGGAGTCCTAAGGACACTCGACGGAATACCGGAC |
| | ********************************************************** |
| P-SETit.Cys-1:1:2 | TTAGACTGTTTTAAGTGCGTTCGTTTCGGATAATTGTGTTCTGATAGCGATTAGACGCGCTTA |
| P-SETit.Cys-1:1:3 | TTAGACTGTTTTAAGTGCGTTCGTTTCGGATAATTGTGTTCTGATAGCGATTAGACGCGCTTA |
| | ********************************************************** |
| P-SETit.Cys-1:1:2 | AACCAGTTTAAGTTGGGCGGTTCCGCCACACTATCCCTTATTACTGATTTTGGTTTGGTT |
| P-SETit.Cys-1:1:3 | AACCAGTTTAAGTTGGGCGGTTCCGCCACACTATCCCTTATTACTGATTTTGGTTTGGTT |
| | ********************************************************** |
| P-SETit.Cys-1:1:2 | TGGGTCCATCCGAGATGAAGAAGAGGCAAGCACATGTACTGGAATAATATTCCTGGATCG |
| P-SETit.Cys-1:1:3 | TGGGTCCATCCGAGATGAAGAAGAGGCAAGCACATGTACTGGAATAATATTCCTGGATCG |
| | ********************************************************** |
| P-SETit.Cys-1:1:2 | AAGGTATGAGCATCACACATTTAAATGCTAGTATTAAGAAGAGGCAAGCACATGTACTGG |
| P-SETit.Cys-1:1:3 | AAGGTATGAGCATCACACATTTAAATGCTAGTATTAAGAAGAGGCAAGCACATGTACTGG |
| | ********************************************************** |

FIG. 3c

```
P-SETit.Cys-1:1:2      AATAATATCCGAGATGCAAGTTTACAACAATAACTCTGGCATTGCATCACCTGCTCAACC
P-SETit.Cys-1:1:3      AATAATATCCGAGATGCAAGTTTACAACAATAACTCTGGCATTGCATCACCTGCTCAACC
                       ************************************************************

P-SETit.Cys-1:1:2      CATGTCCAATCACATGATAATCCTACCAAACTTAGCACGAGCTGAATTAAAATTTTCCTT
P-SETit.Cys-1:1:3      CATGTCCAATCACATGATAATCCTACCAAACTTAGCACGAGCTGAATTAAAATTTTCCTT
                       ************************************************************

P-SETit.Cys-1:1:2      AATCCGTTTTATATATGTACAAATGCCACCATTGCCACATAAATGCATAAGTTCTTCCCA
P-SETit.Cys-1:1:3      AATCCGTTTTATATATGTACAAATGCCACCATTGCCACATAAATGCATAAGTTCTTCCCA
                       ************************************************************

P-SETit.Cys-1:1:2      GATAATTCTATAGGCCACCATTGCTATTTTATAAGAATCCTTCAGAATTTAAGCTGAAA
P-SETit.Cys-1:1:3      GATAATTCTATAGGCCACCATTGCTATTTTATAAGAATCCTTCAGAATTTAAGCTGAAA
                       ***********************************************************

P-SETit.Cys-1:1:2      GGAACTTGACTAAAGGAGGAACAACAAGGATAGAGTCTAGTGCTCCATCCCATGCTACAG
P-SETit.Cys-1:1:3      GGAACTTGACTAAAGGAGGAACAACAAGGATAGAGTCTAGTGCTCCATCCCATGCTACAG
                       ************************************************************

P-SETit.Cys-1:1:2      ATTTTAGTTCAGTTTTCAACCAACAAGAATTAAAATTTATTTCTAGCAAATGAAAATTC
P-SETit.Cys-1:1:3      ATTTTAGTTCAGTTTTCAACCAACAAGAATTAAAATTTATTTCTAGCAAATGAAAATTC
                       ***********************************************************

P-SETit.Cys-1:1:2      AAGGGTCATTTTCTTAAGGTTTGAAGTTATACCATTTTGCATATATATCATAAGTATACA
P-SETit.Cys-1:1:3      AAGGGTCATTTTCTTAAGGTTTGAAGTTATACCATTTTGCATATATATCATAAGTATACA
                       ************************************************************

P-SETit.Cys-1:1:2      AACTTTAGCCATATAATTTTTGCTGGCCACACCTTGGCTACTTTATAAAGACCCTGCACA
P-SETit.Cys-1:1:3      AACTTTAGCCATATAATTTTTGCTGGCCACACCTTGGCTACTTTATAAAGACCCTGCACA
                       ************************************************************
```

FIG. 3d

```
P-SETit.Cys-1:1:2   ATTTTAAGATAAAAGAAATTCGGCAAATTAAAGGGAGAAACAACAAGGAACGAGTCAGGT
P-SETit.Cys-1:1:3   ATTTTAAGATAAAAGAAATTCGGCAAATTAAAGGGAGAAACAACAAGGAACGAGTCAGGT
                    ************************************************************

P-SETit.Cys-1:1:2   GCCCCATCCCATGTTTCCATCGAGATGAAGAAGGGGCAAAGCACATGTACTTGAATATAT
P-SETit.Cys-1:1:3   GCCCCATCCCATGTTTCCATCGAGATGAAGAAGGGGCAAAGCACATGTACTTGAATATAT
                    ************************************************************

P-SETit.Cys-1:1:2   TGGATCGAAGGTATTATCAGCATCAAATATTTGAATACGAGTAGTATTAATAACTTTGAG
P-SETit.Cys-1:1:3   TGGATCGAAGGTATTATCAGCATCAAATATTTGAATACGAGTAGTATTAATAACTTTGAG
                    ************************************************************

P-SETit.Cys-1:1:2   CAGCGCGGAAGGTTCTTATGGCCTCAGTGATAGCTAATCTAACTTTACAATATCTCTGAC
P-SETit.Cys-1:1:3   CAGCGCGGAAGGTTCTTATGGCCTCAGTGATAGCTAATCTAACTTTACAATATCTCTGAC
                    ************************************************************

P-SETit.Cys-1:1:2   ATTGCATCACATGCTCATCCCATGTCACATGATAATAATCCTACCAAGCTCAGCACGAGC
P-SETit.Cys-1:1:3   ATTGCATCACATGCTCATCCCATGTCACATGATAATAATCCTACCAAGCTCAGCACGAGC
                    ************************************************************

P-SETit.Cys-1:1:2   CACATGAAATTTCTTAATCCTTTTTTTATATATATATATAAATGCAAAAGATTGGATCAGAG
P-SETit.Cys-1:1:3   CACATGAAATTTCTTAATCCTTTTTTTATATATATATATAAATGCAAAAGATTGGATCAGAG
                    ************************************************************

P-SETit.Cys-1:1:2   CAAGTAGCTAAGTATCCTGCATCCCTCTTCATGTCCATGAATCATATCCCGATGAACCA
P-SETit.Cys-1:1:3   CAAGTAGCTAAGTATCCTGCATCCCTCTTCATGTCCATGAATCATATCCCGATGAACCA
                    ************************************************************

P-SETit.Cys-1:1:2   CATAACCTCCTTTATTCTTTCAAAACAAGTTAAAAAATTTGTTCTAGAAATGAATTT
P-SETit.Cys-1:1:3   CATAACCTCCTTTATTCTTTCAAAACAAGTTAAAAAATTTGTTCTAGAAATGAATTT
                    ************************************************************
```

FIG. 3e

```
P-SETit.Cys-1:1:2    TTAACTCTGGTTTCTTAAGGTTTGATTTTTTTGCGTCTATATATAAGTTCTTTACAGAT
P-SETit.Cys-1:1:3    TTAACTCTGGTTTCTTAAGGTTTGATTTTTTTGCGTCTATATATAAGTTCTTTACAGAT
                     ***********************************************************

P-SETit.Cys-1:1:2    AACTGTACCTTTGCTAGTTTATATGAATCCTGCAGAGTTTCAAGGTGAAATTAAGGAAC
P-SETit.Cys-1:1:3    AACTGTACCTTTGCTAGTTTATATGAATCCTGCAGAGTTTCAAGGTGAAATTAAGGAAC
                     ***********************************************************

P-SETit.Cys-1:1:2    TTGGAAGTGGGAGAAACTGAGGATCGAGTCCAGTGCTTTATCGGTTTATCATCCCATACT
P-SETit.Cys-1:1:3    TTGGAAGTGGGAGAAACTGAGGATCGAGTCCAGTGCTTTATCGGTTTATCATCCCATACT
                     ***********************************************************

P-SETit.Cys-1:1:2    AATGATTTCTTTTTGTTCAGTTGCATGTTGCAACCGGGATGACGAATCGAATATGCAAAT
P-SETit.Cys-1:1:3    AATGATTTCTTTTTGTTCAGTTGCATGTTGCAACCGGGATGACGAATCGAATATGCAAAT
                     ***********************************************************

P-SETit.Cys-1:1:2    CACATGTACAGGGTTTACTGGCATCTTTTTTGGATCGAAGGTACGAGCACCGCATTTGAA
P-SETit.Cys-1:1:3    CACATGTACAGGGTTTACTGGCATCTTTTTTGGATCGAAGGTACGAGCACCGCATTTGAA
                     ***********************************************************

P-SETit.Cys-1:1:2    TATGAGCACTGACGTTAAGCTTCGTTAGTGGGTGAGGTTTTGCACTGTGTAAATTTCTCT
P-SETit.Cys-1:1:3    TATGAGCACTGACGTTAAGCTTCGTTAGTGGGTGAGGTTTTGCACTGTGTAAATTTCTCT
                     ***********************************************************

P-SETit.Cys-1:1:2    ACTCGTGATTCCAGTGATCTGCATAATGTCAACGGCCGTATAGGAGCAACTACTATTTAA
P-SETit.Cys-1:1:3    ACTCGTGATTCCAGTGATCTGCATAATGTCAACGGCCGTATAGGAGCAACTACTATTTAA
                     ***********************************************************

P-SETit.Cys-1:1:2    GCATCCATTCGCCCATCTATTTCGATCAACGCTCACT
P-SETit.Cys-1:1:3    GCATCCATTCGCCCATCTATTTCGATCAACGCTCACT
                     *************************************
```

FIG. 3f

| | | |
|---|---|---|
| P-SETit.Dzs-1:1:4 | TTTTGGGACGCGAGCAGCTTTAGAGCTGGGATGACGGCCTCTCTTCGTGTGCTCGAGGCG | |
| P-SETit.Dzs-1:1:5 | | |
| P-SETit.Dzs-1:1:4 | TTGCGTCACCCTAGGTTTTCCCTAGGCCAGAGGTAAGATAGTTTGCCTGCGGCAACGCC | |
| P-SETit.Dzs-1:1:5 | | |
| P-SETit.Dzs-1:1:4 | TTTAGTATTGGAAACCTTGGCTGCTTTCTTCAAGGCTTTCTGCTCCAAATGAAGAATATT | |
| P-SETit.Dzs-1:1:5 | | |
| P-SETit.Dzs-1:1:4 | TTTCTTCGATGCCTCGCGAACGGGGCCTCGACGCTGAAGAAGGAAAAGACACGATTCCC | |
| P-SETit.Dzs-1:1:5 | | |
| P-SETit.Dzs-1:1:4 | CCAGGATCCACCCAGCCTCCTTTGAACCTCTCTTTGTACTCCGAAGGAGATTCGGCACCAAG | |
| P-SETit.Dzs-1:1:5 | | |
| P-SETit.Dzs-1:1:4 | AATAAAATCACCACGATCTTTAACCTTAATGGAATTGATCTCTACAAAATGAAGCGCAGG | |
| P-SETit.Dzs-1:1:5 | | |
| P-SETit.Dzs-1:1:4 | AAAAGTTATGTAACGAAGAGAGAAAGCATGAAGAAAAATCAATACAGAGGAGGACAAGCGTA | |
| P-SETit.Dzs-1:1:5 | | |
| P-SETit.Dzs-1:1:4 | GAGTCTTAATTCTTTGGTAAACTTGAAACATTTCGACCAATCCGGGCAAGGGATAGGCC | |
| P-SETit.Dzs-1:1:5 | | |
| P-SETit.Dzs-1:1:4 | CTTTGGTATCAGTCCAGTCGGAGTCCAGAATTGCCCAGCTACAGCGGACAGGCCACACTC | |
| P-SETit.Dzs-1:1:5 | | |
| P-SETit.Dzs-1:1:4 | CAAGCATGCGGTACTCCTCGATAATATCGCAAGTGCTATACTTGCAGGCAAAGAGACGAA | |
| P-SETit.Dzs-1:1:5 | | |
| P-SETit.Dzs-1:1:4 | GCATCGAGATGAAGGCATCACCCTCGGCACATGCGGGAGGGTCAATCTTGTAATCATCAT | |
| P-SETit.Dzs-1:1:5 | | |

FIG. 4a

| | |
|---|---|
| P-SETit.Dzs-1:1:4 | GAAGAGCCTCCATCTTTTTAGTGACGAGGCAGTTGGGCTCACCAGTCTCTTCAGGCTCCA |
| P-SETit.Dzs-1:1:5 | |
| P-SETit.Dzs-1:1:4 | CTTCATGATAGAGCTAGTGTTGATGCCAATCGATAGGCCACTTGTTGCCATATGCAGCCA |
| P-SETit.Dzs-1:1:5 | |
| P-SETit.Dzs-1:1:4 | CGGGGTTCAAGACTCCAGTGCGTTACATGAAGTGAGACATCCAAACTGAGCTTGTTTCC |
| P-SETit.Dzs-1:1:5 | |
| P-SETit.Dzs-1:1:4 | CGACCACTCCATTAGCACTTCTCTCCAACAAGTACTTCAGCTGGTGATGCACCTTGTGAG |
| P-SETit.Dzs-1:1:5 | |
| P-SETit.Dzs-1:1:4 | CATTAGTGAAACTGACTGCCGAGGACTTGATTTTTGTTGTTTGCAAATCCACATATACG |
| P-SETit.Dzs-1:1:5 | |
| P-SETit.Dzs-1:1:4 | TCGAAAGATGAACGAGAGCGTTGGGTGTCAACTGATGCAGGTAGATATCATACAGACGGA |
| P-SETit.Dzs-1:1:5 | |
| P-SETit.Dzs-1:1:4 | GTATATCTATAACAATTGGGTCCAACTCAAAACGAAGACCAACATAAAGGAGATCACGGA |
| P-SETit.Dzs-1:1:5 | |
| P-SETit.Dzs-1:1:4 | AGATGACGACCTTGTTGTCTTCGGGTTTCGAATAACCTCAGAATTGGGTGCACGGCTAG |
| P-SETit.Dzs-1:1:5 | |
| P-SETit.Dzs-1:1:4 | CAAAGACCATCTCTTGTTCTGCTTCAGTAAGTCGATGTCATTGGGATGAAGCAAGCTTCAGC |
| P-SETit.Dzs-1:1:5 | |
| P-SETit.Dzs-1:1:4 | CAAAAAACAGTCTTTGGCATAATCTGATCACCATCGTCACCCGAAGGGCGGTTGCATT |
| P-SETit.Dzs-1:1:5 | |
| P-SETit.Dzs-1:1:4 | TTGGGGCCATTGAATACAATGAAGAACACAATTAAGCAACCAAAATGAAGTCGTCGGAAG |
| P-SETit.Dzs-1:1:5 | |

FIG. 4b

```
P-SETit.Dzs-1:1:4   AATACCAAACCCAGTGAAGGGGGCTTTAGACCTCCATCAAAGAAAGCGATAGCCGTAAAA
P-SETit.Dzs-1:1:5   ------------------------------------------------------------

P-SETit.Dzs-1:1:4   GTAAATGGCACGAGCCCACACAGGGTTATTTATAGGTAGAGCGAAAGAGAAACAGTAACA
P-SETit.Dzs-1:1:5   ------------------------------------------------------------

P-SETit.Dzs-1:1:4   AGGGTCAAAAGTCAAAAAACCATTAAAAAAATTTAATGAAGGATTTCGAATAAGGAAAAA
P-SETit.Dzs-1:1:5   ------------------------------------------------------------

P-SETit.Dzs-1:1:4   TATATTAATCAAAGGGCAAGGAAGCAAAATCATGCATGGGCCGATCTTGGGGAGTTCCGA
P-SETit.Dzs-1:1:5   ------------------------------------------------------------

P-SETit.Dzs-1:1:4   AGGATGGTTGCACCATGTGTTTTAGGATCGTAAGTTCAGCCCATCAGAGGAGAAGATGGC
P-SETit.Dzs-1:1:5   ------------------------------------------------------------

P-SETit.Dzs-1:1:4   CCTCGCTCACGAGGGCTACTATTGGGAAACCACCTTGGGAATCTCCTTCGAAGGGAGA
P-SETit.Dzs-1:1:5   ----------------------------------------------------------

P-SETit.Dzs-1:1:4   AGTCCTTTTGACACTAACCATGACAGCTAGTTTGCTTTGTGGCGAGCTCTAAGTGCAGGG
P-SETit.Dzs-1:1:5   ------------------------------------------------------------

P-SETit.Dzs-1:1:4   AAGAAGAAGGCGTACGAAGAGCTCTTAGGCGTATGAGGGCTCCTTCGGAACAAAACAAT
P-SETit.Dzs-1:1:5   -----------------------------------------------------------

P-SETit.Dzs-1:1:4   GGCTGACTGGCCCGCGGGTCTTTTGGGAGGGCCGGCATCTGACTCGTCCCCTCCAAGTT
P-SETit.Dzs-1:1:5   -----------------------------------------------------------

P-SETit.Dzs-1:1:4   TGTCCTCAGAGGAAAGGCATGGAGTGGCTCAGCAAAGAGCACCTCGACTTCCGAAGATGA
P-SETit.Dzs-1:1:5   ------------------------------------------------------------

P-SETit.Dzs-1:1:4   ACATGCGTTGAAAGACCATGCTGTCCACCACATGGATTGAAAGGACCGTACGAGGAGCTA
P-SETit.Dzs-1:1:5   ------------------------------------------------------------
```

FIG. 4c

```
P-SETit.Dzs-1:1:4      GCTGGAGGAGTCCATACAAAAGATTTGCACTTGAAGAAACCCAATCTGTAGATCATAAAG
P-SETit.Dzs-1:1:5      ------------------------------------------------------------

P-SETit.Dzs-1:1:4      CCAACGTCCTTGGAAAAAACCGAGAAATGATACATGGCCTCATAGAGGTGAATAATTCGA
P-SETit.Dzs-1:1:5      ------------------------------------------------------------

P-SETit.Dzs-1:1:4      AATCACTATCAATTCCTCCAAGACATGATTGCAGAATGAGGCTAACAGAATCCACATTGA
P-SETit.Dzs-1:1:5      ------------------------------------------------------------

P-SETit.Dzs-1:1:4      GAGGGATGGAGGATCGCCCAAAAGAAGCCACCAAGAAAAACTCATTGGAAGAGAAGGCGT
P-SETit.Dzs-1:1:5      ------------------------------------------------------------

P-SETit.Dzs-1:1:4      GTGAGCAACTGACTGGCAAAGAGAAACTGGATTGGATCATGCATTGGATCTCCAAACCTA
P-SETit.Dzs-1:1:5      ------------------------------------------------------------

P-SETit.Dzs-1:1:4      GACCAAAGTCCAGATCAGAGAGGCCACCCATGGTATGGTAGCCTAGAGGAAGGATCACCA
P-SETit.Dzs-1:1:5      ------------------------------------------------------------

P-SETit.Dzs-1:1:4      TGATCGCCGAGGAATGGAGAGCACGACACCGGGAGGAGGGGACATCGCCAGTCACCAT
P-SETit.Dzs-1:1:5      ------------------------------------------------------------

P-SETit.Dzs-1:1:4      ACTCGCATTCTTTTAGCGTCTGCTCATCTCCACTACCCTCCCCTAGTCCCCTATCTAGT
P-SETit.Dzs-1:1:5      ------------------------------------------------------------

P-SETit.Dzs-1:1:4      TGCAGTGCCCACCACTAGATGGTGCCACCACGCTAAACGTCAAGTCTCTCCTTCC
P-SETit.Dzs-1:1:5      ----------------------------------AAACGTCAAGTCTCTCCTTCC
                                                         ******************

P-SETit.Dzs-1:1:4      CCGGCACCGCCCCCCTATCTAGTTGCAATGCCACCACTAGATGTGCCACCACGCTAACC
P-SETit.Dzs-1:1:5      CCGGCACCGCCCCCTATCTAGTTGCAATGCCCACCACTAGATGCCCACCACGCTAACC
                       *********** ***********************  ***********************
```

FIG. 4d

| | | |
|---|---|---|
| P-SETit.Dzs-1:1:4 | TAAACGTCAAGTCTCTCCTGCCCCAGCACCGCCCATCAGCAATCGTTGCCTGCCCACAAG | |
| P-SETit.Dzs-1:1:5 | TAAACGTCAAGTCTCTCCTCCTTCCCCAGCACCGCCCATCAGCAATCGTTGCCTGCCCACAAG | |
| | ★★★★ ★★★★★★★★★★★★★★★★★★★★★★★★★★★★★★★★★★★★★★★★★★★★★★★★★★★★★★ | |
| P-SETit.Dzs-1:1:4 | CACGACACGATGGCACTTATGGAATCCTCTTAATACCAACACTACTCCAATCCAAAAATT | |
| P-SETit.Dzs-1:1:5 | CACGACACGATGGCACTTATGGAATCCTCTTAATACCAACACTACTCCAATCCAAAAATT | |
| | ★★★★★★★★★★★★★★★★★★★★★★★★★★★★★★★★★★★★★★★★★★★★★★★★★★★★★★★★★★★★ | |
| P-SETit.Dzs-1:1:4 | TAACATTGCAGTTTGATTTTGCTCTCGACCTAAAGAATCACAAAAATTAATTAGGTGTC | |
| P-SETit.Dzs-1:1:5 | TAACATTGCAGTTTGATTTTGCTCTCGACCTAAAGAATCAC-AAAATTAATTAGGTGTC | |
| | ★★★★★★★★★★★★★★★★★★★★★★★★★★★★★★★★★★★★★★★★★ ★★★★★★★★★★★★★★★★★★ | |
| P-SETit.Dzs-1:1:4 | TGGAATCTATGAAGTGCGAGAGAGTAATTAATAAATCATGTATATATGTCCAGTTGTTGT | |
| P-SETit.Dzs-1:1:5 | TGGAATCTATGAAGTGCCAGAGAGTAATTAATAAATCATGTATATATGTCCAGTTGTTGT | |
| | ★★★★★★★★★★★★★★★★★ ★★★★★★★★★★★★★★★★★★★★★★★★★★★★★★★★★★★★★★★★★★ | |
| P-SETit.Dzs-1:1:4 | TTGGGGAAACCTGTCTCTGTGCAAAAGCAGGGTCCTTTGCCCATGTACTTTTACTATCAG | |
| P-SETit.Dzs-1:1:5 | TTGGGGAAACCTGTCTCTGTGCAAAAGCAGGGTCCTTTGCCCATGTACTTTTACTATCAG | |
| | ★★★★★★★★★★★★★★★★★★★★★★★★★★★★★★★★★★★★★★★★★★★★★★★★★★★★★★★★★★★★ | |
| P-SETit.Dzs-1:1:4 | TCAACAAGGCAGCATTCTCTCATAAAACCACGAAAGTAAAGGAACCAAGACCATCACAGA | |
| P-SETit.Dzs-1:1:5 | TCAACAAGGCAGCATTCTCTCATAAAACCACGAAAGTAAAGGAACCAAGACCATCACAGA | |
| | ★★★★★★★★★★★★★★★★★★★★★★★★★★★★★★★★★★★★★★★★★★★★★★★★★★★★★★★★★★★★ | |
| P-SETit.Dzs-1:1:4 | CTCCGTGCATGAGTTATGACATGTGAGTAATGACATGTAAAGCCAAATCAGCCTGGACAAAT | |
| P-SETit.Dzs-1:1:5 | CTCCGTGCATGAGTTATGACATGTGAGTAATGACATGTAAAGCCAAATCAGCCTGGACAAAT | |
| | ★★★★★★★★★★★★★★★★★★★★★★★★★★★★★★★★★★★★★★★★★★★★★★★★★★★★★★★★★★★★ | |
| P-SETit.Dzs-1:1:4 | GTCCACAGAAGACTCCATGTGTGAGTAATGACATGTAAAGCCAAATCAGCCTGGACAAAT | |
| P-SETit.Dzs-1:1:5 | GTCCACAGAAGACTCCATGTGTGAGTAATGACATGTAAAGCCAAATCAGCCTGGACAAAT | |
| | ★★★★★★★★★★★★★★★★★★★★★★★★★★★★★★★★★★★★★★★★★★★★★★★★★★★★★★★★★★★★ | |
| P-SETit.Dzs-1:1:4 | TCCGTTGCAGAAGACCACAGTAGACTCCATGTATGAGTTAAGAGTTATATGACATGTAGAG | |
| P-SETit.Dzs-1:1:5 | TCCGTTGCAGAAGACCACAGTAGACTCCATGTATGAGTTAAGAGTTATATGACATGTAGAG | |
| | ★★★★★★★★★★★★★★★★★★★★★★★★★★★★★★★★★★★★★★★★★★★★★★★★★★★★★★★★★★★★ | |
| P-SETit.Dzs-1:1:4 | CATATCAGCGCCTGGACAAATTCCCTTGCAGAAGTTTCTCGATCCACCTCAGCTAGTCAC | |
| P-SETit.Dzs-1:1:5 | CATATCAGCGCCTGGACAAATTCCCTTGCAGAAGTTTCTCGATCCACCTCAGCTAGTCAC | |
| | ★★★★★★★★★★★★★★★★★★★★★★★★★★★★★★★★★★★★★★★★★★★★★★★★★★★★★★★★★★★★ | |
| P-SETit.Dzs-1:1:4 | GATGCAATCACCTTACTTTAGCAAAAGCAAAACAAACTGAGATATGCAGTCACATCCTTA | |
| P-SETit.Dzs-1:1:5 | GATGCAATCACCTTACTTTAGCAAAAGCAAAACAAACTGAGATATGCAGTCACATCCTTA | |
| | ★★★★★★★★★★★★★★★★★★★★★★★★★★★★★★★★★★★★★★★★★★★★★★★★★★★★★★★★★★★★ | |

FIG. 4e

```
P-SETit.Dzs-1:1:4    ATAAACTCGTCATACTACCCTCACCCTATTATCAAAAGTAAGAACAACAAAATACTTTTC
P-SETit.Dzs-1:1:5    ATAAACTCGTCATACTACCCTCACCCTATTATCAAAAGTAAGAACAACAAAATACTTTTC
                     ************************************************************

P-SETit.Dzs-1:1:4    CCATGTACCCCATGCTGAATATCATGGAGGCGATCATGTGGGTCCAAAAACAGTTAGGGA
P-SETit.Dzs-1:1:5    CCATGTACCCCATGCTGAATATCATGGAGGCGATCATGTGGGTCCAAAAACAGTTAGGGA
                     ************************************************************

P-SETit.Dzs-1:1:4    AATCTCCAAATTTGACTAGATGCCATGTCACCTCCAGCTTATCTACCCTCCAACTTTCAG
P-SETit.Dzs-1:1:5    AATCTCCAAATTTGACTAGATGCCATGTCACCTCCAGCTTATCTACCCTCCAACTTTCAG
                     ************************************************************

P-SETit.Dzs-1:1:4    TTCTGCAAATGACAAAAACCTTATTGATCTGCACGGTGTTTGTAGCATATAAGCACTATA
P-SETit.Dzs-1:1:5    TTCTGCAAATGACAAAAACCTTATTGATCTGCACGGTGTTTGTAGCATATAAGCACTATA
                     ************************************************************

P-SETit.Dzs-1:1:4    AATAGGACCTAGATGAATGCTCAGCCCA
P-SETit.Dzs-1:1:5    AATAGGACCTAGATGAATGCTCAGCCCA
                     ****************************
```

FIG. 4f

```
P-SETit.Gst-1:1:1    GGATGATGATGGAATGCTTTTGAGAATGACTTCTTAAAGCGTCAAGCTTTTCTGACTGTGTCA
P-SETit.Gst-1:1:2    ---------------------------------------------------------------

P-SETit.Gst-1:1:1    GGTCAGCTTCAGGTTGAAACTTATGCTTGTGCTCTCAGTAGTGTATATACCTTTGGACCA
P-SETit.Gst-1:1:2    ------------------------------------------------------------

P-SETit.Gst-1:1:1    ACGTTCCGGGCAGAGAACTCACATACATCAAGACATCTGGCAGAGTTTTGGATGGTTGAA
P-SETit.Gst-1:1:2    ------------------------------------------------------------

P-SETit.Gst-1:1:1    CCAGAAAATGCATTTGCAAACTTGCAGGTGAGCTGCTTCTTGATGACTAACTTTATTACT
P-SETit.Gst-1:1:2    ------------------------------------------------------------

P-SETit.Gst-1:1:1    TTGTGGTTCGCCACCTATCAAATTGGATCATGGGGTTTTGTGTGGACATAACTAAATGTTA
P-SETit.Gst-1:1:2    ------------------------------------------------------------

P-SETit.Gst-1:1:1    AACTTGTATAAATTGTGTCACAGGATGATATGAACTGTGCAGAAAAATATGTACAATACC
P-SETit.Gst-1:1:2    ------------------------------------------------------------

P-SETit.Gst-1:1:1    TCTGCCAGTGGTTACTCGATCATTGTGAAGAAGACATAGATTTCATTAGCAAAAAATACG
P-SETit.Gst-1:1:2    ------------------------------------------------------------

P-SETit.Gst-1:1:1    AGAGAAACAGTAGACATAATCAAACTGCAATTGACCGTCTGAAGCTTGTTCCTCAACGC
P-SETit.Gst-1:1:2    -----------------------------------------------------------

P-SETit.Gst-1:1:1    ATTTTGAACGTATTTCATACACAATGGCTGTGGACATTCTGAAAAATACAGAACAAGGTT
P-SETit.Gst-1:1:2    ------------------------------------------------------------

P-SETit.Gst-1:1:1    GAATGGGGAATCGATTTAGCATCTGAGCATGAAAGGTATGTGCAAGTTGTCAGTTGATCT
P-SETit.Gst-1:1:2    ------------------------------------------------------------

P-SETit.Gst-1:1:1    TACTGGTCTTCACCTGATTACCTTCTTTGATTGGTTAACTGTAACTACGTATTCTGTGA
P-SETit.Gst-1:1:2    -----------------------------------------------------------
```

FIG. 5a

```
P-SETit.Gst-1:1:1    AGGTATTGACTGAGGTGATATATAAGAAGCCAGTTATTGTTTATAACTATCCCAAAGAA
P-SETit.Gst-1:1:2    -----------------------------------------------------------

P-SETit.Gst-1:1:1    ATAAAAGCATTTATATGAGGCTCAATGATGATCAGAAGACTGTTTCTGCTATGGATGTT
P-SETit.Gst-1:1:2    -----------------------------------------------------------

P-SETit.Gst-1:1:1    CTTGCGCCACAGGTATAGATCGAATTGTTGAAATGTCTATGATGCTGTCCATTGTTCACT
P-SETit.Gst-1:1:2    -----------------------------------------------------------

P-SETit.Gst-1:1:1    GAAGTGCCCACACCATTCTACCCTCAATCAGCATGGATATAAGCAGCCAGATTCATGTC
P-SETit.Gst-1:1:2    -----------------------------------------------------------

P-SETit.Gst-1:1:1    TGCTCTTAGTAGAATATAACTATTTCTTTCTGCCTTTTAGAATTTAGATATCTCTGGATT
P-SETit.Gst-1:1:2    -----------------------------------------------------------

P-SETit.Gst-1:1:1    CTTTTTTCGCCTTTTCACCAATTACAAAGAACTAAAACTGCATATAACTATATTAAGATA
P-SETit.Gst-1:1:2    -----------------------------------------------------------

P-SETit.Gst-1:1:1    ACAATATTTACATTTCTGAAATAGCTGTATGCTTGCAACTACATGCTGGATATTTGCT
P-SETit.Gst-1:1:2    -----------------------------------------------------------

P-SETit.Gst-1:1:1    TTGCCTGCTGCTTGTATATAGTTTGAAAGTGAGCTTTGTGGCCGATGATTTCTACCTAACCA
P-SETit.Gst-1:1:2    -----------------------------------------------------------

P-SETit.Gst-1:1:1    TAAATTATTTCCTTGGTAGGTTGGTGAATTGACTGGTGGAAGCCAGAGGAGCATCTAGA
P-SETit.Gst-1:1:2    -----------------------------------------------------------

P-SETit.Gst-1:1:1    TGTCCTGAAACAGAGGTACCGACTTGCTCAATATAATTTGTTTCTATCAGGATCAATAT
P-SETit.Gst-1:1:2    ------------------------------------------------CAGGAT----T
                                                                     ******  *
```

FIG. 5b

```
P-SETit.Gst-1:1:1   TAGGTTTCATTTGCTCGTCGTCGGTGGAGGTAGCAAGCAGTTTTGTCCATCATTGGTTCACGA
P-SETit.Gst-1:1:2   TAGGTTTCATTTGCTCGTCGTCGGTGGAGGTAGCAAGCAGTTTTGTCCATCATTGGTTCACGA
                    ************************************************************

P-SETit.Gst-1:1:1   ATATTTGCTGAACATTGTCCAATATATTGTTCTACAGAATTTTGGATGCGGGATTGCCCAT
P-SETit.Gst-1:1:2   ATATTTGCTGAACATTGTCCAATATATTGTTCTACAGAATTTTGGATGCGGGATTGCCCAT
                    ************************************************************

P-SETit.Gst-1:1:1   CACCCCTGATGCGAGCTAGTCTGCTTCATGGCGAGGCGGTGTGACCTCGACGTGCAGGGTGC
P-SETit.Gst-1:1:2   CACCCCTGATGCGAGCTAGTCTGCTTCATGGCGAGGCGGTGTGACCTCGACGTGCAGGGTGC
                    ************************************************************

P-SETit.Gst-1:1:1   CAGGGTAGAGTGCCCATCACCCCTGACGCGAGCTAGTCTGCTTACGCAAGCAGCGACGTC
P-SETit.Gst-1:1:2   CAGGGTAGAGTGCCCATCACCCCTGACGCGAGCTAGTCTGCTTACGCAAGCAGCGACGTC
                    ************************************************************

P-SETit.Gst-1:1:1   ACAAGTGTAGTAAAAGGCCTCGTTGACCCACGACCAATCCACCGCTTCCTCTAGCACCTT
P-SETit.Gst-1:1:2   ACAAGTGTAGTAAAAGGCCTCGTTGACCCACGACCAATCCACCGCTTCCTCTAGCACCTT
                    ************************************************************

P-SETit.Gst-1:1:1   CTTCCCCGAGCACCGGCAGGCAGCGAGATCTAGGCAGCCATCGCTCCTCTTCTC
P-SETit.Gst-1:1:2   CTTCCCCGAGCACCGGCAGGCAGCGAGATCTAGGCAGCCATCGCTCCTCTTCTC
                    ************************************************************

P-SETit.Gst-1:1:1   CCCCCTGCTCCTGTATAAATAGCAGCAGGGCAACCAATTCCATCAACTCGTATCA
P-SETit.Gst-1:1:2   CCCCCTGCTCCTGTATAAATAGCAGCAGGGCAACCAATTCCATCAACTCGTATCA
                    ************************************************************

P-SETit.Gst-1:1:1   T
P-SETit.Gst-1:1:2   T
                    *
```

FIG. 5c

```
P-SETit.lfr-1:1:2    TCCACCGATCATCACACAGCCAGTAGTGGGGTGGGCCAAGCAATCAGGCACCCGGCA
P-SETit.lfr-1:1:3    ---------------------------------------------------------

P-SETit.lfr-1:1:2    ATGCGAGCTGATGCCGTGATGATGGTGCTACCAACAAACTGACTATAAATTTCTGATTTG
P-SETit.lfr-1:1:3    ------------------------------------------------------------

P-SETit.lfr-1:1:2    AAAGGGATTGGCCTCGATATTTTATTAGCTCCCCGGCTTTTGTCACGACACGTTAGCATG
P-SETit.lfr-1:1:3    ------------------------------------------------------------

P-SETit.lfr-1:1:2    CGTGCCTTCTAGAAGCTAGTCCGGGTATTACCGCTAGAAAGTTCCCGAAATGAAGCATTT
P-SETit.lfr-1:1:3    ------------------------------------------------------------

P-SETit.lfr-1:1:2    ACCACCCGTAAAGCTCATTTTTCTTTATGATGAGTAGACACGGTACCAACATTGAGGACC
P-SETit.lfr-1:1:3    ------------------------------------------------------------

P-SETit.lfr-1:1:2    GATTGGTTGGCTCCCAAAATCTGCCCTGCCAAACTAGGGCAAGTTCATAAATTTTGACAT
P-SETit.lfr-1:1:3    ------------------------------------------------------------

P-SETit.lfr-1:1:2    TCGCTTGGTTGGCAATCAATTAAATCCTATTCTAAAATTCTTGCCTAGGTTTTGATATAA
P-SETit.lfr-1:1:3    ------------------------------------------------------------

P-SETit.lfr-1:1:2    CATGCCCTATATTTGGTCTACTCAAATTTTGGTATGGTAAATTTTGAACACCAACAAAT
P-SETit.lfr-1:1:3    ---------------------------------------------------------

P-SETit.lfr-1:1:2    CAGGCTATTATTTATCTTATCTCTTTCTCAATTCATTACACAGCAAGGCAGTAATTAAA
P-SETit.lfr-1:1:3    ---------------------------------------------------------

P-SETit.lfr-1:1:2    AGGACCGTATATACAATGGATGTAAGAATAAAAATGTATAAGTAGAAATATATTGGCATGC
P-SETit.lfr-1:1:3    ------------------------------------------------------------
```

FIG. 6a

```
P-SETit.Ifr-1:1:2    CTCGTGCTGGTGCATGTCGATATGCTCTCAATTAGAAGTTGGAGACAGGTTATGCTTAGG
P-SETit.Ifr-1:1:3    ------------------------------------------------------------

P-SETit.Ifr-1:1:2    ATAGTCCCAACCTATGATATCTGTGTGTCTATACTGCCACATAAGTAAGACATCACTTTA
P-SETit.Ifr-1:1:3    ------------------------------------------------------------

P-SETit.Ifr-1:1:2    GAAATTACATTCTACAACCTATAATTTCTTAGTGTGGATCCTTAATTAATTCATCATCTC
P-SETit.Ifr-1:1:3    ------------------------------------------------------------

P-SETit.Ifr-1:1:2    TCCTCTCAATTCCTCATCAATTATGAAGACACCATCTTCTTCCAATGCAAATTTAACACT
P-SETit.Ifr-1:1:3    ------------------------------------------------------------

P-SETit.Ifr-1:1:2    GTCTAGGATCTAGGTTCAGGTGTTGATACTGGGTCTTGCATGAGATCCAGTTTCTTGTTC
P-SETit.Ifr-1:1:3    ------------------------------------------------------------

P-SETit.Ifr-1:1:2    TTCCAATTCTCTCTCATTTAATATATAATCACATAAGCAAAAGATCCTATGTAGCTGCAC
P-SETit.Ifr-1:1:3    ------------------------------------------------------------

P-SETit.Ifr-1:1:2    AATTAATGCTATGGAAACTATCCTAATCGGAGGGTTGGGACTGCTCCTGCCTATGGCGGC
P-SETit.Ifr-1:1:3    ------------------------------------------CCTGCCTATGGCGGC
                                                               ***************

P-SETit.Ifr-1:1:2    TTATTCCCCATTTGCCTAACCTGAAAATCGAAAGGGAGTGCATGACAGGCAAACACTAG
P-SETit.Ifr-1:1:3    TTATTCCCCATTTGCCTAACCTGAAAATCGAAAGGGAGTGCATGACAGGCAAACACTAG
                     ***********************************************************
```

FIG. 6b

```
P-SETit.Ifr-1:1:2    TGTTGCCTGCATCAATAATCGTCCATGATTATATAGAGGTAGCATGACTTTTTAGGCGT
P-SETit.Ifr-1:1:3    TGTTGCCTGCATCAATAATCGTCCATGATTATATAGAGGTAGCATGACTTTTTAGGCGT
                     ***********************************************************

P-SETit.Ifr-1:1:2    CGTGTCCTAATCAATCAGAAAAGAAAAGCCAACCTAATCGCTATGGGCCGCAACCACCGAT
P-SETit.Ifr-1:1:3    CGTGTCCTAATCAATCAGAAAAGAAAAGCCAACCTAATCGCTATGGGCCGCAACCACCGAT
                     ************************************************************

P-SETit.Ifr-1:1:2    GCGACTATGCGAGTATATGGAACCCGTTGCTACTCCCCACTATATATCGTGGAGTCTGA
P-SETit.Ifr-1:1:3    GCGACTATGCGAGTATATGGAACCCGTTGCTACTCCCCACTATATATCGTGGAGTCTGA
                     ***********************************************************

P-SETit.Ifr-1:1:2    TGGCAATCCAACGGGCAGACG
P-SETit.Ifr-1:1:3    TGGCAATCCAACGGGCAGACG
                     *********************
```

```
P-SETit.Nrt2-1:1:2    ACTATGGCGGGCGTGGTGTGAGAGACCCCCGCACGTGGTGTTCTTCAAGGCGATGAGAGTGAG
P-SETit.Nrt2-1:1:3    ---------------------------------------------------------------

P-SETit.Nrt2-1:1:2    GTGGAGTCCAACGGCGGATGTGGCGAGGTCCCCGCGCATTGTGTTATCGCGGTGGCGACT
P-SETit.Nrt2-1:1:3    ---------------------------------------------------------------

P-SETit.Nrt2-1:1:2    GCGAGGCAGCCTAAGAGAGGTCCGGATTCGGTGGTATCACTCTGTCAGATAGAGTGTGGT
P-SETit.Nrt2-1:1:3    ---------------------------------------------------------------

P-SETit.Nrt2-1:1:2    GTTGCAGCGGCACTACAGCGGAGGTCTCGTATGCGGGTGGCCATCTCGGTGCAGTGCAG
P-SETit.Nrt2-1:1:3    ---------------------------------------------------------------

P-SETit.Nrt2-1:1:2    TCTGTTTCTATCGGTTCCCTGTCGATGCCGGACCACGCCTAGACGTTTCGGCGAGTTATG
P-SETit.Nrt2-1:1:3    ---------------------------------------------------------------

P-SETit.Nrt2-1:1:2    AGCGTGGATGTTGGTGGGTGCCGCCGTGGCCGAGCAGAGCGGTGAGACCGTGTTGATGTCC
P-SETit.Nrt2-1:1:3    ---------------------------------------------------------------

P-SETit.Nrt2-1:1:2    CAATCCAATCGGTAGGGTGTGATAGTTTGGTGTTGAGTGGCTATCTGCATTGATGTCCT
P-SETit.Nrt2-1:1:3    ---------------------------------------------------------------

P-SETit.Nrt2-1:1:2    AATCCGACCAGGCGAGTTTGTATTGTTTCTTTTCCTTTTATATTTTTCAGTC
P-SETit.Nrt2-1:1:3    ---------------------------------------------------------------

P-SETit.Nrt2-1:1:2    TGAAATTCTTTTTTAATATAATCGGCAGCTCTCCAATATGGTTCGTTCAAAAAAAGAA
P-SETit.Nrt2-1:1:3    ---------------------------------------------------------------

P-SETit.Nrt2-1:1:2    TTTTTAAGAAAAGATAGATAAAAAGATAAACCAAATTCTGAATTGTGATTCAGATACCCT
P-SETit.Nrt2-1:1:3    ---------------------------------------------------------------

P-SETit.Nrt2-1:1:2    CGAAATGGAAGTTGGCCTGTCCCACTTAAAATTGAACGCATGATTCCGTCAATAATTCAGT
P-SETit.Nrt2-1:1:3    ---------------------------------------------------------------
```

```
P-SETit.Nrt2-1:1:2    GCCGTCCTCCTGTTTACTCTTTAATTCTTATTACGTGACATCGGCCCGTTGATAAGCCGT
P-SETit.Nrt2-1:1:3    ------------------------------------------------------------

P-SETit.Nrt2-1:1:2    GCTCCTTGTCGCTAATTCTTATTACGTGCTGATAGAGGCGAGTCAATCAAACGTTGCACT
P-SETit.Nrt2-1:1:3    ------------------------------------------------------------

P-SETit.Nrt2-1:1:2    TTGTAACCCTTAATCTTTGCTAAGAGTCACATGACCCCGTACATCTCGATCGATCCTCTT
P-SETit.Nrt2-1:1:3    ------------------------------------------------------------

P-SETit.Nrt2-1:1:2    TTAGTTGGCGCGCGGGTTTTACCATGTGAAGCAATGTGCCGGCATGCTGCTGTCGCAACT
P-SETit.Nrt2-1:1:3    ------------------------------------------------------------

P-SETit.Nrt2-1:1:2    AGCTCTTCATCAAGCTATCGACAGATGAGATGCGCTCCCATTGGAACCGAAATGGGTGGA
P-SETit.Nrt2-1:1:3    ------------------------------------------------------------

P-SETit.Nrt2-1:1:2    AATTCTGTTCGATTCTGTCGTGCCGACCGTGCGAAAGTGAAACCACCCTTCCCCTCGCCG
P-SETit.Nrt2-1:1:3    ------------------------------------------------------------

P-SETit.Nrt2-1:1:2    CAGGCATGTAGTCCGCGTGGATTTGAACACCAGCTGACATATGCCTCCATGTCCATT
P-SETit.Nrt2-1:1:3    ------------------------------------------------------------

P-SETit.Nrt2-1:1:2    CCTGCCGTGGGAATCTCTGCACCTGGTCTGCCTAGTCCTACAGGCTGCGGCCGCACCATC
P-SETit.Nrt2-1:1:3    ------------------------------------------------------------

P-SETit.Nrt2-1:1:2    TAAAATGCATGTTTGAATATCAGTAGTTAAATTTATCACATGTCACATCGGATATTCGGA
P-SETit.Nrt2-1:1:3    ------------------------------------------------------------

P-SETit.Nrt2-1:1:2    TGCTAATTAGTAGGACTAAACATAGCTAATTATAAAATTAATTGCAGAACTTCGGGGCTA
P-SETit.Nrt2-1:1:3    ------------------------------------------------------------

P-SETit.Nrt2-1:1:2    ATTCATGAGACCAATTTATTGAGGCTAATTAATCTATCATTAGCAAATGGTTACTGTAGC
P-SETit.Nrt2-1:1:3    ------------------------------------------------------------
```

FIG. 7b

```
P-SETit.Nrt2-1:1:2    ACCATATTGTCAAATCATGGACTAATTAGCCTTAATAGATTTATCTCACAAATTAGACTC
P-SETit.Nrt2-1:1:3    ------------------------------------------------------------

P-SETit.Nrt2-1:1:2    CATCTGTGTAATTAGTTTTATAATTAGATTATATTTAATACTTCTAATTAGTATCCAAAT
P-SETit.Nrt2-1:1:3    ------------------------------------------------------------

P-SETit.Nrt2-1:1:2    ATCCGATGTGACTGTGAAGTTTAACACATGTGAGCCAAACACCCCGACCACCCGGTCGC
P-SETit.Nrt2-1:1:3    ------------------------------------------CCGACCACCCGGTCGC
                                                                *****************

P-SETit.Nrt2-1:1:2    CGCGCCGCCGCCGCCCGCCGTTGGATGCCGCCCTCGCCACGCGCCATGCGACGCAACGCCCCTGCAC
P-SETit.Nrt2-1:1:3    CGCGCCGCCGCCGCCCGCCGTTGGATGCCGCCCTCGCCACGCGCCATGCGACGCAACGCCCCTGCAC
                      ******************************************************************

P-SETit.Nrt2-1:1:2    TGCATTTCGTGGCCTTGCGTAGGGCCACCGGAAGAGCCGTGGTTCGTTCGTTCGTCCC
P-SETit.Nrt2-1:1:3    TGCATTTCGTGGCCTTGCGTAGGGCCACCGGAAGAGCCGTGGTTCGTTCGTTCGTCCC
                      **********************************************************

P-SETit.Nrt2-1:1:2    CTGGCCGCCTCAGCTGATTTGCGAGCAGGGTCGAATCGATCGCGCCGGTCGCCGCATCC
P-SETit.Nrt2-1:1:3    CTGGCCGCCTCAGCTGATTTGCGAGCAGGGTCGAATCGATCGCGCCGGTCGCCGCATCC
                      ************************************************************

P-SETit.Nrt2-1:1:2    CACCAAGCCGGAGCCCTTCGGGGCCCCTCTAAAAGCAAGTCAGGCTCGCGAAGTGACCGA
P-SETit.Nrt2-1:1:3    CACCAAGCCGGAGCCCTTCGGGGCCCCTCTAAAAGCAAGTCAGGCTCGCGAAGTGACCGA
                      ************************************************************
```

FIG. 7c

```
P-SETit.Nrt2-1:1:2      AAAGATACATTACTACCAGCTGCAGCGCTGCTGTTGGCCCTGCCCTCGTCAAGATCTGAC
P-SETit.Nrt2-1:1:3      AAAGATACATTACTACCAGCTGCAGCGCTGCTGTTGGCCCTGCCCTCGTCAAGATCTGAC
                        ************************************************************

P-SETit.Nrt2-1:1:2      TTTTGAATCGCATAATTAGCAGCTTGTTTATTAAGCTTAAACGATTGATCCTACTCCTTG
P-SETit.Nrt2-1:1:3      TTTTGAATCGCATAATTAGCAGCTTGTTTATTAAGCTTAAACGATTGATCCTACTCCTTG
                        ************************************************************

P-SETit.Nrt2-1:1:2      CCGACA
P-SETit.Nrt2-1:1:3      CCGACA
                        ******
```

FIG. 7d

```
P-SETit.Ppc-1:1:3    CCATCTCTCCTGAAAGAGAACTATGTTTAAGTTTCAACAAGAGACAACAATGCCCTTGT
P-SETit.Ppc-1:1:4    ------------------------------------------------------------

P-SETit.Ppc-1:1:3    GAACTGACAAAAGAGATAACAGGAAAAGACAAGGATTCGAGGAAGCAAGAAGGCAAGTGA
P-SETit.Ppc-1:1:4    ------------------------------------------------------------

P-SETit.Ppc-1:1:3    GCAGTGAATTGCAGTACTACCGAACAAGACTGATTTTTAGTACAGTACCTAATTATTTTG
P-SETit.Ppc-1:1:4    ------------------------------------------------------------

P-SETit.Ppc-1:1:3    GAATAATGAATAAGAGAGGATAATGTTGGACGAATAAAAATTGTGAACGGAAAATAACTA
P-SETit.Ppc-1:1:4    ------------------------------------------------------------

P-SETit.Ppc-1:1:3    GATATGTTTTGGGAGGCACTAACAAGACTTTAATTTGGAAGAGAGATACAAACATATAAA
P-SETit.Ppc-1:1:4    ------------------------------------------------------------

P-SETit.Ppc-1:1:3    CATGTTAGTGGATAGATAATATGGTGTCTTATGTTAGAAAAGTACATTATTTTTTATGGT
P-SETit.Ppc-1:1:4    ------------------------------------------------------------

P-SETit.Ppc-1:1:3    TATTTCATAGATCTGGAACATTAATACAAAACTAATCCTATGGATACAAAACTGCATGA
P-SETit.Ppc-1:1:4    ------------------------------------------------------------

P-SETit.Ppc-1:1:3    AAAGTAATCATGAATTTATTCTAATATTGGGCATCATATTTAAGTCACGTTGCAGAATTT
P-SETit.Ppc-1:1:4    ------------------------------------------------------------

P-SETit.Ppc-1:1:3    GAACTTAAAACTCGATTCGTACGTGGAGAAACAAAAAAGATCAAATCTCATTAGAGGTAT
P-SETit.Ppc-1:1:4    ------------------------------------------------------------

P-SETit.Ppc-1:1:3    ATTGGACCATTTAAAGTAGTTTGGGGAATAAATCGAGCCTAAGTTTTATTTAGGGGTTA
P-SETit.Ppc-1:1:4    ------------------------------------------------------------

P-SETit.Ppc-1:1:3    AGAGGACAGATAAAGTAGATTGGTGATGGTAGTAAAATGGACATTTTCCTAGTTGTATCT
P-SETit.Ppc-1:1:4    ------------------------------------------------------------

P-SETit.Ppc-1:1:3    GGTATGTACTATTTGGCTTAACATATATATTAAGTCCCAAGTAGTGCAAATTGGATTCAAA
P-SETit.Ppc-1:1:4    ------------------------------------------------------------
```

FIG. 8a

```
P-SETit.Ppc-1:1:3    TACTAAATTCTCTTACGTAGAGATGAGGAAGGAGAATTACAAAGCAGCATTGCCACAGC
P-SETit.Ppc-1:1:4    ------------------------------------------------------------

P-SETit.Ppc-1:1:3    CTTGCTTCAGTTTTGCTCGATGCAAGCAGGGTGGAGTGGTGGACAGGCATGGACTAGCGG
P-SETit.Ppc-1:1:4    ------------------------------------------------------------

P-SETit.Ppc-1:1:3    CACGGAAGACAACATCATGTGCTTCCAGAGTTGCCAACGGCAAAAGAGCAGCAATG
P-SETit.Ppc-1:1:4    CACGGAAGACAACATCATGTGCTTCCAGAGTTGCCAACGGCAAAAGAGCAGCAATG
                     ********************************************************

P-SETit.Ppc-1:1:3    TGTGTAGTTCGGCCATGGGCTCGGTCACAGGTGGGTTCGTCTCCCAGAACAGGCAGGAGA
P-SETit.Ppc-1:1:4    TGTGTAGTTCGGCCATGGGCTCGGTCACAGGTGGGTTCGTCTCCCAGAACAGGCAGGAGA
                     ************************************************************

P-SETit.Ppc-1:1:3    GGGGGTAGCTGGCTGAGCATCCATCCGTGATGAGCCTAAACCGTTGCGCAAACGGGCAGC
P-SETit.Ppc-1:1:4    GGGGGTAGCTGGCTGAGCATCCATCCGTGATGAGCCTAAACCGTTGCGCAAACGGGCAGC
                     ************************************************************

P-SETit.Ppc-1:1:3    TGGAGAGATAATGCGAATATGTGATCCTCCACGGCGTTGCCACAGATGTCACGGATCATG
P-SETit.Ppc-1:1:4    TGGAGAGATAATGCGAATATGTGATCCTCCACGGCGTTGCCACAGATGTCACGGATCATG
                     ************************************************************

P-SETit.Ppc-1:1:3    CATGCATGTCGTCATTTAGCAGATGTTTGAGTCTGATACACCCTTCACACCAAGCAAATT
P-SETit.Ppc-1:1:4    CATGCATGTCGTCATTTAGCAGATGTTTGAGTCTGATACACCCTTCACACCAAGCAAATT
                     ************************************************************

P-SETit.Ppc-1:1:3    ATAACCAAGATAAGGATTCGAGGAAGCAGAAGGAGGCAAGTGAGCAGTGACAAGTACGTC
P-SETit.Ppc-1:1:4    ATAACCAAGATAAGGATTCGAGGAAGCAGAAGGAGGCAAGTGAGCAGTGACAAGTACGTC
                     ************************************************************

P-SETit.Ppc-1:1:3    CACAACACAATCCAGACGAAAACGAACACATCAATGCCCTCGGCGCCAATCGTAGTAATG
P-SETit.Ppc-1:1:4    CACAACACAATCCAGACGAAAACGAACACATCAATGCCCTCGGCGCCAATCGTAGTAATG
                     ************************************************************
```

FIG. 8b

```
P-SETit.Ppc-1:1:3    CTGCAACAAACAAAGTCCTGTGAAGACGGTCTCTATTAAATAGCCACACATGGAGCCGAT
P-SETit.Ppc-1:1:4    CTGCAACAAACAAAGTCCTGTGAAGACGGTCTCTATTAAATAGCCACACATGGAGCCGAT
                     ************************************************************

P-SETit.Ppc-1:1:3    ATATAATCCGAAAGATAATGTAATAATAGAGAAGCGTCATGTTTTTCAAAATAAAAAT
P-SETit.Ppc-1:1:4    ATATAATCCGAAAGATAATGTAATAATAGAGAAGCGTCATGTTTTTCAAAATAAAAAT
                     ************************************************************

P-SETit.Ppc-1:1:3    AAAAATAAACTGGGAACAAGCCCATCGCAAGGCCGAGCGAGCTTGCTTTTCAGAGTCA
P-SETit.Ppc-1:1:4    AAAAATAAACTGGGAACAAGCCCATCGCAAGGCCGAGCGAGCTTGCTTTTCAGAGTCA
                     ************************************************************

P-SETit.Ppc-1:1:3    GTGAGCCACCGGGCGCGGGAGCTGACGGGTAGGGGAAGAGGAAGAACAACATCGTGCATGTGC
P-SETit.Ppc-1:1:4    GTGAGCCACCGGGCGCGGGAGCTGACGGGTAGGGGAAGAGGAAGAACAACATCGTGCATGTGC
                     ************************************************************

P-SETit.Ppc-1:1:3    TTCAAGAGTTGCCAACGGCAAAGGAGCAGCAGTGTGTAGTTCGGCTATGGGCTCAGTC
P-SETit.Ppc-1:1:4    TTCAAGAGTTGCCAACGGCAAAGGAGCAGCAGTGTGTAGTTCGGCTATGGGCTCAGTC
                     ************************************************************

P-SETit.Ppc-1:1:3    ACAGGTGGGTTTCGTCTCCCAGAACCAGCAGCAGGAGAGGGGTTTGTGGCTGGCTGTGCATC
P-SETit.Ppc-1:1:4    ACAGGTGGGTTTCGTCTCCCAGAACCAGCAGCAGGAGAGGGGTTTGTGGCTGGCTGTGCATC
                     ************************************************************

P-SETit.Ppc-1:1:3    CATCCGTGATGAGCCTAAACCGTTGCCGCAAATGGACACCTGGAGCGATAATGTGAATATG
P-SETit.Ppc-1:1:4    CATCCGTGATGAGCCTAAACCGTTGCCGCAAATGGACACCTGGAGCGATAATGTGAATATG
                     ************************************************************

P-SETit.Ppc-1:1:3    TGATCCTCCACGGCGTTGCCACAAATGTCACTGATCATCCATGTTGTCCTATAGCACATG
P-SETit.Ppc-1:1:4    TGATCCTCCACGGCGTTGCCACAAATGTCACTGATCATCCATGTTGTCCTATAGCACATG
                     ************************************************************
```

FIG. 8c

```
P-SETit.Ppc-1:1:3    CTTGAGTCCAAGTCCCTCCACACCAAGCAAATTATAGCCAAGACAAGGATTCAAGGAAGC
P-SETit.Ppc-1:1:4    CTTGAGTCCAAGTCCCTCCACACCAAGCAAATTATAGCCAAGACAAGGATTCAAGGAAGC
                     ************************************************************

P-SETit.Ppc-1:1:3    AAGAAGGCGAGTGAGCAGTGACAAAGTATGTCCACAGCACAATCCGTACGAAAACGAGCG
P-SETit.Ppc-1:1:4    AAGAAGGCGAGTGAGCAGTGACAAAGTATGTCCACAGCACAATCCGTACGAAAACGAGCG
                     ************************************************************

P-SETit.Ppc-1:1:3    CATCAGTGCCCTCAGCGCCAATCGTAGTGTTTCCGCATCAAATAAGTCCTGTGAAGCCGG
P-SETit.Ppc-1:1:4    CATCAGTGCCCTCAGCGCCAATCGTAGTGTTTCCGCATCAAATAAGTCCTGTGAAGCCGG
                     ************************************************************

P-SETit.Ppc-1:1:3    TCTCTATTAAATTGCCACGTATGAAGCCGATGTGGTCCGAAAGATAATATGCAATAAT
P-SETit.Ppc-1:1:4    TCTCTATTAAATTGCCACGTATGAAGCCGATGTGGTCCGAAAGATAATATGCAATAAT
                     **********************************************************

P-SETit.Ppc-1:1:3    AGAGAAGCGTTATGTTTCCCTGAAAAAAACCTGGAACAAGCCTGTCGCAAGGCCGGGA
P-SETit.Ppc-1:1:4    AGAGAAGCGTTATGTTTCCCTGAAAAAAACCTGGAACAAGCCTGTCGCAAGGCCGGGA
                     **********************************************************

P-SETit.Ppc-1:1:3    GCCTCGCTTCCGTCTTGCTTTTTCACAGTCAGTGAGCCACCGGGCGGGGAGCTGACGGGTA
P-SETit.Ppc-1:1:4    GCCTCGCTTCCGTCTTGCTTTTTCACAGTCAGTGAGCCACCGGGCGGGGAGCTGACGGGTA
                     ************************************************************

P-SETit.Ppc-1:1:3    GGGGAAGAGGAAGACAGCACCGTGCATGTGCTTCCAGAGTTGCCAACGGCAAATGAGCAG
P-SETit.Ppc-1:1:4    GGGGAAGAGGAAGACAGCACCGTGCATGTGCTTCCAGAGTTGCCAACGGCAAATGAGCAG
                     ************************************************************

P-SETit.Ppc-1:1:3    CAGTGTGTGTAGTTCGGCCATGGGCTCGGTCACAGGTGGGTTTCGTCTCCCAGAACCAGC
P-SETit.Ppc-1:1:4    CAGTGTGTGTAGTTCGGCCATGGGCTCGGTCACAGGTGGGTTTCGTCTCCCAGAACCAGC
                     ************************************************************
```

FIG. 8d

```
P-SETit.Ppc-1:1:3   AGGAGAGGGGTATGTGGCTGGCTGTGCATCCATCCGTGATGAGCCTAAACCGTTGCGCA
P-SETit.Ppc-1:1:4   AGGAGAGGGGTATGTGGCTGGCTGTGCATCCATCCGTGATGAGCCTAAACCGTTGCGCA
                    ************************************************************

P-SETit.Ppc-1:1:3   AACGGACACCTAGAGCGATAATGTATATGTGATCCTCCACGGCGTTGCCACAAATGTCAC
P-SETit.Ppc-1:1:4   AACGGACACCTAGAGCGATAATGTATATGTGATCCTCCACGGCGTTGCCACAAATGTCAC
                    ************************************************************

P-SETit.Ppc-1:1:3   TGATCATGCATGTTGTCCTATATAGCACATGCTTGAGTCCAAGTCCCTCCACACCAAGCA
P-SETit.Ppc-1:1:4   TGATCATGCATGTTGTCCTATATAGCACATGCTTGAGTCCAAGTCCCTCCACACCAAGCA
                    ************************************************************

P-SETit.Ppc-1:1:3   AATTAATTATAGCCAAGAGAAGGATTCGAGGAAGAAGAAGGCGATTGAGCAGTGACAAGT
P-SETit.Ppc-1:1:4   AATTAATTATAGCCAAGAGAAGGATTCGAGGAAGAAGAAGGCGATTGAGCAGTGACAAGT
                    ************************************************************

P-SETit.Ppc-1:1:3   ACGTCGACAGCACAACCCAGACGAAAACCAGGCAACGAGCACATCGCTCCGCAGCGCTGC
P-SETit.Ppc-1:1:4   ACGTCGACAGCACAACCCAGACGAAAACCAGGCAACGAGCACATCGCTCCGCAGCGCTGC
                    ************************************************************

P-SETit.Ppc-1:1:3   CCCTCGGCCCTCCCCTTGCATTCGTGATTCGCCGCCGGTCACATGCCCTCCGCTTGAAAA
P-SETit.Ppc-1:1:4   CCCTCGGCCCTCCCCTTGCATTCGTGATTCGCCGCCGGTCACATGCCCTCCGCTTGAAAA
                    ************************************************************

P-SETit.Ppc-1:1:3   AAAAAAAGCCCCCTTTCCATCCGCCATGAGGCGTGCAATCCCGTGCACACACTCGCCGA
P-SETit.Ppc-1:1:4   AAAAAAAGCCCCCTTTCCATCCGCCATGAGGCGTGCAATCCCGTGCACACACTCGCCGA
                    ************************************************************

P-SETit.Ppc-1:1:3   CTCCCCATCCGTTATTTGTTTTTTTAGAAGCCCCATCCGTTATTTAAACCACCCGCG
P-SETit.Ppc-1:1:4   CTCCCCATCCGTTATTTGTTTTTTTAGAAGCCCCATCCGTTATTTAAACCACCCGCG
                    ************************************************************

P-SETit.Ppc-1:1:3   CGCCTCGCTCGACCTCGTGCCA
P-SETit.Ppc-1:1:4   CGCCTCGCTCGACCTCGTGCCA
                    **********************
```

FIG. 8e

```
P-SETit.Prx3-1:1:3   ------------------------------------------------------------
P-SETit.Prx3-1:1:4   ACGCAAATGACAAATAATGGTTACACCAAATAATAGGTTAACGCAAATGACAAATAATGGTT

P-SETit.Prx3-1:1:3   ------------------------------------------------------------
P-SETit.Prx3-1:1:4   ACACAAAACTGCAGTCTAATCTGTTTATGAAATCTATCATATACCTGTAGCTTGAAAGCA

P-SETit.Prx3-1:1:3   ------------------------------------------------------------
P-SETit.Prx3-1:1:4   ACTGCTAGCACGAGCAAACATCTCGAATGACAAATAATGGTTTCTCCACTCATCTGCAAA

P-SETit.Prx3-1:1:3   ------------------------------------------------------------
P-SETit.Prx3-1:1:4   TAAGAAAATCGCTCAGGCAAAATCTCTTAAAAGTGCGAAAAATGTGGAGTTGAACAAAAT

P-SETit.Prx3-1:1:3   ------------------------------------------------------------
P-SETit.Prx3-1:1:4   AAATCACTACCGACACATTATTCTGAGGGGCAAAACGCAGATCCGGGCCACAAAGCAACC

P-SETit.Prx3-1:1:3   ------------------------------------------------------------
P-SETit.Prx3-1:1:4   GGATTAGAAGCTGACAAGCTTGGAGGCTGTGTTGACTCAACGAGCTTGGAGATTGGCAGA

P-SETit.Prx3-1:1:3   ------------------------------------------------------------
P-SETit.Prx3-1:1:4   TCCGGTGAAGGTGGCTGCAGATCTGTGCAGGGAGTTGTCAATGCACAAGTACTATCATTC

P-SETit.Prx3-1:1:3   ------------------------------------------------------------
P-SETit.Prx3-1:1:4   TAAACTAGGATTAGCTTCTACTGCTCACCTTTTTACAAGCAGTCAAAGTCAGCATGCGGT

P-SETit.Prx3-1:1:3   ------------------------------------------------------------
P-SETit.Prx3-1:1:4   GGCACCAGCCGGAAGGATCGGGCTTGTAACGACAGTTTCTGATGTTAATCGCGTGCTTCAG

P-SETit.Prx3-1:1:3   ------------------------------------------------------------
P-SETit.Prx3-1:1:4   AGATTGAGTAAAGTGCTGTTAATTTTCCAGAAGCCTAGGAAAAAACACATCTGGACCCTA

P-SETit.Prx3-1:1:3   ------------------------------------------------------------
P-SETit.Prx3-1:1:4   CCTTAAGCAACAACACGTCATGCTTCACAGAATAGCAGCATTATAATCCTGTCAAACAAT
```

FIG. 9a

```
P-SETit.Prx3-1:1:3   ----------------------------------------------------------------
P-SETit.Prx3-1:1:4   ACCACTTTTGCAATATGTCAAACAAACACATGGATAAACTGAAATGAAGTCATCCCTTT

P-SETit.Prx3-1:1:3   ----------------------------------------------------------------
P-SETit.Prx3-1:1:4   GAAGCCAAGGGTAGTCTCCCGATAGTCAACAAAGTATTCTTCGACGACCATCACATACAC

P-SETit.Prx3-1:1:3   ----------------------------------------------------------------
P-SETit.Prx3-1:1:4   ACATACAACTAGCAGCATCATAATCATAACAGTGATCTGAACGGAATTGTTAGACGATTT

P-SETit.Prx3-1:1:3   ----------------------------------------------------------------
P-SETit.Prx3-1:1:4   ACATTTCCTCGCTATAGATTTATTCAAAATAAGGCCAAACATCTTCTATGGATGTTCTAA

P-SETit.Prx3-1:1:3   ----------------------------------------------------------------
P-SETit.Prx3-1:1:4   TCATAACTAATGTAACATCAAGAGAAAAAAGGTAATGCTTTGACCAAATTGGTGAAATAT

P-SETit.Prx3-1:1:3   ----------------------------------------------------------------
P-SETit.Prx3-1:1:4   GGTAATATAACACATTATAATTATGAACCTAATCAAAGTGTTCTGGGCCACATAAAATAA

P-SETit.Prx3-1:1:3   ----------------------------------------------------------------
P-SETit.Prx3-1:1:4   ATTAAAAGATATTTGCCAACGAATATAATGCCTTCTTTTTTAATCAATGCTTGCTTACAA

P-SETit.Prx3-1:1:3   ----------------------------------------------------------------
P-SETit.Prx3-1:1:4   ATTACAAGCATATCCCTGTGAGGGGCACACAAAATCTGGCCACCACATCCGGGTTTGGTA

P-SETit.Prx3-1:1:3   ----------------------------------------------------------------
P-SETit.Prx3-1:1:4   GAAGAAACATCATATCAGAATAACATCATATCATTAAACAGCTCTCCGATCAGTTGCTAAT

P-SETit.Prx3-1:1:3   ----------------------------------------------------------------
P-SETit.Prx3-1:1:4   AACATATCAGAATAACATCATATCTAGATATAGTATATGTCTAGATGCATAATAATATCT

P-SETit.Prx3-1:1:3   ----------------------------------------------------------------
P-SETit.Prx3-1:1:4   ATAAATTTAGAAAAGCTAAAACGACCTACACAATTTGGAATGGAGGAGTAGTTGTTTTCTT

P-SETit.Prx3-1:1:3   ----------------------------------------------------------------
P-SETit.Prx3-1:1:4   TATTTAGAGTTCGATCGGTTACGTAATAGTTTCCTTTAATTATTCATGGCAGCTTCCACT
```

FIG. 9b

```
P-SETit.Prx3-1:1:3    ------------------------------------------------------------
P-SETit.Prx3-1:1:4    GACTTACTAAGAAATCATAGACAAATTATTTCAGCTGATGCATGACAAAATAAATAA

P-SETit.Prx3-1:1:3    ------CCTACCTACTAAAACTTTGGCCCTTTCTTCTCAGAAATGTTGGTAAGAGTAAAT
P-SETit.Prx3-1:1:4    TGCTTGCCTACTAAAACTTTGGCCCTTTCTTCTCAGAAATGTTGGTAAGAGTAAAT
                            ********************************************* ****

P-SETit.Prx3-1:1:3    TACCAGAGTAGACCCGGAAAGGGGAGGAGGAGAACATAAGACAGCTATGAATCAGGAGCC
P-SETit.Prx3-1:1:4    TACCAGAGTAGACCCGGAAAGGGGAGGAGGAGAACATAAGACAGCTATGAATCAGGAGCC
                      ************************************************************

P-SETit.Prx3-1:1:3    TAGTCAAATGAGCAGGTAACCTTGTCCATGTCACTTTTTTTTTTTGGTCTCCTCCAGGGTT
P-SETit.Prx3-1:1:4    TAGTCAAATGAGCAGGTAACCTTGTCCATGTCACTTTTTTTTTTTGGTCTCCTCCAGGGTT
                      ************************************************************

P-SETit.Prx3-1:1:3    CAGCAGTTGCTTGGGATGCTAAAAGTTTGTGACCTCTTTTGAGGCATGTAACATGCTATC
P-SETit.Prx3-1:1:4    CAGCAGTTGCTTGGGATGCTAAAAGTTTGTGACCTCTTTTGAGGCATGTAACATGCTATC
                      ************************************************************

P-SETit.Prx3-1:1:3    AGTATAGTTGCTAGGGATATAAAATTTACTCCTCTACCATATGCAAGAAGCCACGAACC
P-SETit.Prx3-1:1:4    AGTATAGTTGCTAGGGATATAAAATTTACTCCTCTACCATATGCAAGAAGCCACGAACC
                      ************************************************************

P-SETit.Prx3-1:1:3    TATCTGCTCTTTGCAATGCATTCATGACAAACTACAGATGTGCATGCCTCTGAAGT
P-SETit.Prx3-1:1:4    TATCTGCTCTTTGCAATGCATTCATGACAAACTACAGATGTGCATGCCTCTGAAGT
                      ************************************************************

P-SETit.Prx3-1:1:3    CTTCTGACAGTAACTACCCTAAAAAAAATCTTCTGACAGTAACTGCCCTAAAAAAAAGTA
P-SETit.Prx3-1:1:4    CTTCTGACAGTAACTACCCTAAAAAAAATCTTCTGACAGTAACTGCCCTAAAAAAAAGTA
                      ************************************************************

P-SETit.Prx3-1:1:3    TGCTGACAGTAACAAAGCACGCTGTGTTTTGTTCCTTGAAGGAACCGGCCACTGATACG
P-SETit.Prx3-1:1:4    TGCTGACAGTAACAAAGCACGCTGTGTTTTGTTCCTTGAAGGAACCGGCCACTGATACG
                      ************************************************************
```

FIG. 9c

```
P-SETit.Prx3-1:1:3    TGCTGCACGGAAGAACCAAGCTTTCTCCCGACCTGTTTGAGTTTGGAAGCTTTCAAACAA
P-SETit.Prx3-1:1:4    TGCTGCACGGAAGAACCAAGCTTTCTCCCGACCTGTTTGAGTTTGGAAGCTTTCAAACAA
                      ************************************************************

P-SETit.Prx3-1:1:3    ACAACATCCAAGCTAAGTCCTTCCAGGAACCTGCTGCTCTCGTGACAAGAATGTAGG
P-SETit.Prx3-1:1:4    ACAACATCCAAGCTAAGTCCTTCCAGGAACCTGCTGCTCTCGTGACAAGAATGTAGG
                      *********************************************************

P-SETit.Prx3-1:1:3    CCATGCGAGCACCTAACACACGGATCATCACGCGCCGTGTGGCTCAGAGTTGGTACACCA
P-SETit.Prx3-1:1:4    CCATGCGAGCACCTAACACACGGATCATCACGCGCCGTGTGGCTCAGAGTTGGTACACCA
                      ************************************************************

P-SETit.Prx3-1:1:3    CATCATATCGCCTGATTGGTCTGTGTACTTGTGTCCCCTGGGAAAATCAGTCACTTATT
P-SETit.Prx3-1:1:4    CATCATATCGCCTGATTGGTCTGTGTACTTGTGTCCCCTGGGAAAATCAGTCACTTATT
                      ***********************************************************

P-SETit.Prx3-1:1:3    TTTAGACCCCTGGATTGAACACAGAATAATGCAACCATGTTAAGCATGTTGTGCA
P-SETit.Prx3-1:1:4    TTTAGACCCCTGGATTGAACACAGAATAATGCAACCATGTTAAGCATGTTGTGCA
                      *******************************************************

P-SETit.Prx3-1:1:3    CAGCCGTTTGACAAGCCATTCCCCATCTTTCATGTAGTGATCCTCACCTAGCTAATGTAA
P-SETit.Prx3-1:1:4    CAGCCGTTTGACAAGCCATTCCCCATCTTTCATGTAGTGATCCTCACCTAGCTAATGTAA
                      ************************************************************

P-SETit.Prx3-1:1:3    CACGGCAAAACTACCCTAATTGGCAGTAGAACTCTGATGTATGGAACCATGACGAATAA
P-SETit.Prx3-1:1:4    CACGGCAAAACTACCCTAATTGGCAGTAGAACTCTGATGTATGGAACCATGACGAATAA
                      ***********************************************************

P-SETit.Prx3-1:1:3    ATGGAAAATCTTAGACGCTACTCACTACTCATCTTGAATCCCAGAAGCTTGTGTACCTTT
P-SETit.Prx3-1:1:4    ATGGAAAATCTTAGACGCTACTCACTACTCATCTTGAATCCCAGAAGCTTGTGTACCTTT
                      ************************************************************
```

FIG. 9d

| | | |
|---|---|---|
| P-SETit.Prx3-1:1:3 | CATTATCATTTCCACAAAGACAGGGATATACTGATACGTGTTCAATGATGACCGAACCATTA | |
| P-SETit.Prx3-1:1:4 | CATTATCATTTCCACAAAGACAGGGATATACTGATACGTGTTCAATGATGACCGAACCATTA | |
| | ************************************************************ | |
| P-SETit.Prx3-1:1:3 | AAAACCAAAGAAACCAGGGGCATAGTCTGCATATGGTCGTCATTAATATAGTAAATTAAG | |
| P-SETit.Prx3-1:1:4 | AAAACCAAAGAAACCAGGGGCATAGTCTGCATATGGTCGTCATTAATATAGTAAATTAAG | |
| | ************************************************************ | |
| P-SETit.Prx3-1:1:3 | TTCAAACTGTAACAACCCTTGTGTATAACAAAAGAAGCTGGACTAACTATGAAGCAAAAC | |
| P-SETit.Prx3-1:1:4 | TTCAAACTGTAACAACCCTTGTGTATAACAAAAGAAGCTGGACTAACTATGAAGCAAAAC | |
| | ************************************************************ | |
| P-SETit.Prx3-1:1:3 | CATGCTTTTCGCCGAGGCTCCTCCTCTGAACTTTGGTTGCTTGGTTTCACATAGTGTTAAACT | |
| P-SETit.Prx3-1:1:4 | CATGCTTTTCGCCGAGGCTCCTCCTCTGAACTTTGGTTGCTTGGTTTCACATAGTGTTAAACT | |
| | ************************************************************ | |
| P-SETit.Prx3-1:1:3 | GTTAATAAGCGAGGTTATATAGTTCGGGTGAATATATTACTACTGGGACGAACTGATATC | |
| P-SETit.Prx3-1:1:4 | GTTAATAAGCGAGGTTATATAGTTCGGGTGAATATATTACTACTGGGACGAACTGATATC | |
| | ************************************************************ | |
| P-SETit.Prx3-1:1:3 | TACCACTAAATCTACTGTAAAGCTGCCTAATTTGCTGTAGCTAGATTTCCCGGAAGGGGG | |
| P-SETit.Prx3-1:1:4 | TACCACTAAATCTACTGTAAAGCTGCCTAATTTGCTGTAGCTAGATTTCCCGGAAGGGGG | |
| | ************************************************************ | |
| P-SETit.Prx3-1:1:3 | CTCTTGTATGCTGCAGAGGACATATTCAACTGATCAATTTATAGACAGAAAGTTGCATAT | |
| P-SETit.Prx3-1:1:4 | CTCTTGTATGCTGCAGAGGACATATTCAACTGATCAATTTATAGACAGAAAGTTGCATAT | |
| | ************************************************************ | |
| P-SETit.Prx3-1:1:3 | TCTATCATTGTGCCTAGCCCCTAGCTATATGATCAGCATAATCAGCAATCCATCATATCT | |
| P-SETit.Prx3-1:1:4 | TCTATCATTGTGCCTAGCCCCTAGCTATATGATCAGCATAATCAGCAATCCATCATATCT | |
| | ************************************************************ | |

FIG. 9e

```
P-SETit.Prx3-1:1:3    TCTTCTCAGTGTTTTTTTTTTTTTGCTGGGCGAAACAATATTCTTTATTTCAGTTCAATCCT
P-SETit.Prx3-1:1:4    TCTTCTCAGTGTTTTTTTTTTTTTGCTGGGCGAAACAATATTCTTTATTTCAGTTCAATCCT
                      * * * * * * * * * * * * * * * * * * * * * * * * * * * * * * *

P-SETit.Prx3-1:1:3    GTTAAGCAGCACTTGCTGTTTCTGCAGTAACCTGTAACCGTACTGTACCTACTGCTGAC
P-SETit.Prx3-1:1:4    GTTAAGCAGCACTTGCTGTTTCTGCAGTAACCTGTAACCGTACTGTACCTACTGCTGAC
                      * * * * * * * * * * * * * * * * * * * * * * * * * * * * * * *

P-SETit.Prx3-1:1:3    TTGTCGCTTCTGAGTGGGAAAAATGTCTCACCTGATCAGAAACGATTTCTTCGCCTACAAT
P-SETit.Prx3-1:1:4    TTGTCGCTTCTGAGTGGGAAAAATGTCTCACCTGATCAGAAACGATTTCTTCGCCTACAAT
                      * * * * * * * * * * * * * * * * * * * * * * * * * * * * * * *

P-SETit.Prx3-1:1:3    TATTTGGGACTAGAAGCTCAATGCTGTCCATGCAAATTTCGGTTAAAACTGAAGCATCAA
P-SETit.Prx3-1:1:4    TATTTGGGACTAGAAGCTCAATGCTGTCCATGCAAATTTCGGTTAAAACTGAAGCATCAA
                      * * * * * * * * * * * * * * * * * * * * * * * * * * * * * * *

P-SETit.Prx3-1:1:3    CAGTCAAAAATGTCAGCTAAAACTGAGGCATCAACAGTCATACTTGCAGCCAGATGGAAGA
P-SETit.Prx3-1:1:4    CAGTCAAAAATGTCAGCTAAAACTGAGGCATCAACAGTCATACTTGCAGCCAGATGGAAGA
                      * * * * * * * * * * * * * * * * * * * * * * * * * * * * * * *

P-SETit.Prx3-1:1:3    ACAACCGTAGCAGTTGGACACAATGTGGAGTCGACCTAGCTCGCTCGTTTGCTCACCCTC
P-SETit.Prx3-1:1:4    ACAACCGTAGCAGTTGGACACAATGTGGAGTCGACCTAGCTCGCTCGTTTGCTCACCCTC
                      * * * * * * * * * * * * * * * * * * * * * * * * * * * * * * *

P-SETit.Prx3-1:1:3    TTATTCTATAAGCATCACCCTAACAAATCCCTAACCACCTTCCCTTCGTTACACACATGC
P-SETit.Prx3-1:1:4    TTATTCTATAAGCATCACCCTAACAAATCCCTAACCACCTTCCCTTCGTTACACACATGC
                      * * * * * * * * * * * * * * * * * * * * * * * * * * * * * * *

P-SETit.Prx3-1:1:3    TAGCTGCCTCCCTCCAGCTATAAATAGCACCCAAAGCCCATCTCATCTGGCCAT
P-SETit.Prx3-1:1:4    TAGCTGCCTCCCTCCAGCTATAAATAGCACCCAAAGCCCATCTCATCTGGCCAT
                      * * * * * * * * * * * * * * * * * * * * * * * * * * *
```

FIG. 9f

```
P-SETit.Rcc3-1:1:1    TATCGGCGACCGCTAAGAGAAGACATTTAAAATAAGTAGTCGGCATTGTGATAAAAGAG
P-SETit.Rcc3-1:1:10   ------------------------------------------------------------
P-SETit.Rcc3-1:1:11   ------------------------------------------------------------
P-SETit.Rcc3-1:1:16   --------------------------------------GTCGGCATTGTGATAAAAGAG

P-SETit.Rcc3-1:1:1    AGCGCGATTACTGATGTGCAGGTTCTCGATTGTTGATGAAGTCGACTAGTCGGAGTCGAT
P-SETit.Rcc3-1:1:10   ------------------------------------------------------------
P-SETit.Rcc3-1:1:11   ------------------------------------------------------------
P-SETit.Rcc3-1:1:16   AGCGCGATTACTGATGTGCAGGTTCTCGATTGTTGATGAAGTCGACTAGTCGGAGTCGAT

P-SETit.Rcc3-1:1:1    TCTGACTAGTTATTGATTGTATGGAACCCGCCCTCGACTAGTTTTCTAGTCGAGACGAGT
P-SETit.Rcc3-1:1:10   ------------------------------------------------------------
P-SETit.Rcc3-1:1:11   ------------------------------------------------------------
P-SETit.Rcc3-1:1:16   TCTGACTAGTTATTGATTGTATGGAACCCGCCCTCGACTAGTTTTCTAGTCGAGACGAGT

P-SETit.Rcc3-1:1:1    AGTCGAAGTAGTAGACCATCCTCAACTACTTTTCTAGTTGAGATGAGTAGTCGAAGTAGTCGT
P-SETit.Rcc3-1:1:10   ------------------------------------------------------------
P-SETit.Rcc3-1:1:11   ------------------------------------------------------------
P-SETit.Rcc3-1:1:16   AGTCGAAGTAGTAGACCATCCTCAACTACTTTTCTAGTTGAGATGAGTAGTCGAAGTAGTCGT

P-SETit.Rcc3-1:1:1    CGGCGACTTGATTATTTGCCTCAATCTGTGTGTGACTTGATCGACGAGCCGTATGCAGCA
P-SETit.Rcc3-1:1:10   ------------------------------------------------------------
P-SETit.Rcc3-1:1:11   ------------------------------------------------------------
P-SETit.Rcc3-1:1:16   CGGCGACTTGATTATTTGCCTCAATCTGTGTGTGACTTGATCGACGAGCCGTATGCAGCA

P-SETit.Rcc3-1:1:1    GCTTGCGGTGGAAACCGACTCAGTCTTCGATTGGAACACGGAGCGCGTCAATTCTATGTC
P-SETit.Rcc3-1:1:10   ------------------------------------------------------------
P-SETit.Rcc3-1:1:11   ------------------------------------------------------------
P-SETit.Rcc3-1:1:16   GCTTGCGGTGGAAACCGACTCAGTCTTCGATTGGAACACGGAGCGCGTCAATTCTATGTC
```

FIG. 10a

```
P-SETit.Rcc3-1:1:1    GACGTAGATTGTCTGCTTGGAACTCCAACTCAGTGACTTGCTTCTTGTTGAGTAGATTG
P-SETit.Rcc3-1:1:10   ------------------------------------------------------------
P-SETit.Rcc3-1:1:11   ------------------------------------------------------------
P-SETit.Rcc3-1:1:16   GACGTAGATTGTCTGCTTGGAACTCCAACTCAGTGACTTGCTTCTTGTTGAGTAGATTG

P-SETit.Rcc3-1:1:1    ATCTTGATGATGAGGTCCTTCAAGCTCGCCTGATGATCTCGACGATCACCTCTACCTGAC
P-SETit.Rcc3-1:1:10   ------------------------------------------------------------
P-SETit.Rcc3-1:1:11   ------------------------------------------------------------
P-SETit.Rcc3-1:1:16   ATCTTGATGATGAGGTCCTTCAAGCTCGCCTGATGATCTCGACGATCACCTCTACCTGAC

P-SETit.Rcc3-1:1:1    GCGCCAACTGTTGGTGCTTAGACCCAGCAACCTACCGAGGGGTACCCGAGGTAGTGTTT
P-SETit.Rcc3-1:1:10   --------------------------AGACCCAGCAACCTACCGAGGGGTACCCGAGGTAGTGTTT
P-SETit.Rcc3-1:1:11   ------------------------------------------------------------
P-SETit.Rcc3-1:1:16   GCGCCAACTGTTGGTGCTTAGACCCAGCAACCTACCGAGGGGTACCCGAGGTAGTGTTT

P-SETit.Rcc3-1:1:1    TGTGCTGGGGCTCGTCGTCGAAGATCAGGAACTTGAAGGTGAACTCGAACACACGATTTAGAC
P-SETit.Rcc3-1:1:10   TGTGGTGGGGCTCGTCGTCGAAGATCAGGAACTTGAAGGTGAACTCGAACACACGATTTAGAC
P-SETit.Rcc3-1:1:11   ------------------------------------------------------------
P-SETit.Rcc3-1:1:16   TGTGGTGGGGCTCGTCGTCGAAGATCAGGAACTTGAAGGTGAACTCGAACACACGATTTAGAC

P-SETit.Rcc3-1:1:1    AAGTTCGGGCTGCTGCTTATGCCGCATAATACCCCATGTCATGTGTGTTGGTTGGATTGTATT
P-SETit.Rcc3-1:1:10   AAGTTCGGGCTGCTGCTTATGCCGCATAATACCCCATGTCATGTGTGTTGGTTGGATTGTATT
P-SETit.Rcc3-1:1:11   ------------------------------------------------------------
P-SETit.Rcc3-1:1:16   AAGTTCGGGCTGCTGCTTATGCCGCATAATACCCCATGTCATGTGTGTTGGTTGGATTGTATT

P-SETit.Rcc3-1:1:1    GATTGATCAGATATTTGGAGGGGGCCCTGCCTGCCTCGCCTTATATTGCCGGAGGCA
P-SETit.Rcc3-1:1:10   GATTGATCAGATATTTGGAGGGGGCCCTGCCTGCCTCGCCTTATATTGCCGGAGGCA
P-SETit.Rcc3-1:1:11   ------------------------------------------------------------
P-SETit.Rcc3-1:1:16   GATTGATCAGATATTTGGAGGGGGCCCTGCCTGCCTCGCCTTATATTGCCGGAGGCA
```

FIG. 10b

| | | |
|---|---|---|
| P-SET1t.Rcc3-1:1:1 | | GGGCTACAGGTCGGTTGTGTGTACAAGAGTACTAGTCGGTTTTGACCAGCGAGTCCTACTC |
| P-SET1t.Rcc3-1:1:10 | | GGGCTACAGGTCGGTTGTGTGTACAAGAGTACTAGTCGGTTTTGACCAGCGAGTCCTACTC |
| P-SET1t.Rcc3-1:1:11 | | ------------------------------------------------------------ |
| P-SET1t.Rcc3-1:1:16 | | GGGCTACAGGTCGGTTGTGTGTACAAGAGTACTAGTCGGTTTTGACCAGCGAGTCCTACTC |
| | | |
| P-SET1t.Rcc3-1:1:1 | | TAATTGCTACAAGTAGTTTCCTAATCCTTGACTAGTCCTTGTCCGCCACGTAGACCACGA |
| P-SET1t.Rcc3-1:1:10 | | TAATTGCTACAAGTAGTTTCCTAATCCTTGACTAGTCCTTGTCCGCCACGTAGACCACGA |
| P-SET1t.Rcc3-1:1:11 | | ------------------------------------------------------------ |
| P-SET1t.Rcc3-1:1:16 | | TAATTGCTACAAGTAGTTTCCTAATCCTTGACTAGTCCTTGTCCGCCACGTAGACCACGA |
| | | |
| P-SET1t.Rcc3-1:1:1 | | CGTCTTGCACCTAGTCTCTGTGTTTGATACATCTTGGTGTACAGTCCGATATTGTAGGAC |
| P-SET1t.Rcc3-1:1:10 | | CGTCTTGCACCTAGTCTCTGTGTTTGATACATCTTGGTGTACAGTCCGATATTGTAGGAC |
| P-SET1t.Rcc3-1:1:11 | | ------------------------------------------------------------ |
| P-SET1t.Rcc3-1:1:16 | | CGTCTTGCACCTAGTCTCTGTGTTTGATACATCTTGGTGTACAGTCCGATATTGTAGGAC |
| | | |
| P-SET1t.Rcc3-1:1:1 | | TATCCAAGCTTCCCAGTAGGCCCATAGATGTATGGCCGACAACTGGATAATGTAACTCTG |
| P-SET1t.Rcc3-1:1:10 | | TATCCAAGCTTCCCAGTAGGCCCATAGATGTATGGCCGACAACTGGATAATGTAACTCTG |
| P-SET1t.Rcc3-1:1:11 | | ------------------------------------------------------------ |
| P-SET1t.Rcc3-1:1:16 | | TATCCAAGCTTCCCAGTAGGCCCATAGATGTATGGCCGACAACTGGATAATGTAACTCTG |
| | | |
| P-SET1t.Rcc3-1:1:1 | | GGTCAGTACTATCCTTATCTATATAGACACAAACAACGTACTATAGCAGAAGTTTAAGCT |
| P-SET1t.Rcc3-1:1:10 | | GGTCAGTACTATCCTTATCTATATAGACACAAACAACGTACTATAGCAGAAGTTTAAGCT |
| P-SET1t.Rcc3-1:1:11 | | ------------------------------------------------------------ |
| P-SET1t.Rcc3-1:1:16 | | GGTCAGTACTATCCTTATCTATATAGACACAAACAACGTACTATAGCAGAAGTTTAAGCT |
| | | |
| P-SET1t.Rcc3-1:1:1 | | CGTAACCCACCAATATTGGTGGCATAGACCACGTATTGCTGATATAGTGCTCGTAACCC |
| P-SET1t.Rcc3-1:1:10 | | CGTAACCCACCAATATTGGTGGCATAGACCACGTATTGCTGATATAGTGCTCGTAACCC |
| P-SET1t.Rcc3-1:1:11 | | ------------------------------------------------------------ |
| P-SET1t.Rcc3-1:1:16 | | CGTAACCCACCAATATTGGTGGCATAGACCACGTATTGCTGATATAGTGCTCGTAACCC |

FIG. 10c

```
P-SETit.Rcc3-1:1:1:1    ACCAATATTTCGTGGCATAGAGATCTCTTAGGCAATAAATTAGCAGTACGAAACAATCTA
P-SETit.Rcc3-1:1:1:10   ACCAATATTTCGTGGCATAGAGATCTCTTAGGCAATAAATTAGCAGTACGAAACAATCTA
P-SETit.Rcc3-1:1:1:11   ------------------------------------------------------------
P-SETit.Rcc3-1:1:1:16   ACCAATATTTCGTGGCATAGAGATCTCTTAGGCAATAAATTAGCAGTACGAAACAATCTA

P-SETit.Rcc3-1:1:1:1    TGTCCACGTGTTGCTAATACAATGTTCTAAACCTTACAGCCTACTGGACAGTTCTCTAGC
P-SETit.Rcc3-1:1:1:10   TGTCCACGTGTTGCTAATACAATGTTCTAAACCTTACAGCCTACTGGACAGTTCTCTAGC
P-SETit.Rcc3-1:1:1:11   ------GTGTTGCTAATACAATGTTCTAAACCTTACAGCCTACTGGACAGTTCTCTAGC
P-SETit.Rcc3-1:1:1:16   TGTCCACGTGTTGCTAATACAATGTTCTAAACCTTACAGCCTACTGGACAGTTCTCTAGC
                              *****************************************************

P-SETit.Rcc3-1:1:1:1    CATGATACATGTGCATGTCCGAACAAATATTTATGGGTACCCGAAAGGTTAATTTTTTGT
P-SETit.Rcc3-1:1:1:10   CATGATACATGTGCATGTCCGAACAAATATTTATGGGTACCCGAAAGGTTAATTTTTTGT
P-SETit.Rcc3-1:1:1:11   CATGATACATGTGCATGTCCGAACAAATATTTATGGGTACCCGAAAGGTTAATTTTTTGT
P-SETit.Rcc3-1:1:1:16   CATGATACATGTGCATGTCCGAACAAATATTTATGGGTACCCGAAAGGTTAATTTTTTGT
                        ************************************************************

P-SETit.Rcc3-1:1:1:1    AGTATTTATGAGGGGGAGGGGGGCGTTGACGAAAAAAATAACTTAGCTAAGCGTAATTGG
P-SETit.Rcc3-1:1:1:10   AGTATTTATGAGGGGGAGGGGGGCGTTGACGAAAAAAATAACTTAGCTAAGCGTAATTGG
P-SETit.Rcc3-1:1:1:11   AGTATTTATGAGGGGGAGGGGGGCGTTGACGAAAAAAATAACTTAGCTAAGCGTAATTGG
P-SETit.Rcc3-1:1:1:16   AGTATTTATGAGGGGGAGGGGGGCGTTGACGAAAAAAATAACTTAGCTAAGCGTAATTGG
                        ************************************************************

P-SETit.Rcc3-1:1:1:1    CTTAAAAAACATACAATGTTGTTCCAGCATCAAGCCTACGTGATCATTTCACAAAACCAAC
P-SETit.Rcc3-1:1:1:10   CTTAAAAAACATACAATGTTGTTCCAGCATCAAGCCTACGTGATCATTTCACAAAACCAAC
P-SETit.Rcc3-1:1:1:11   CTTAAAAAACATACAATGTTGTTCCAGCATCAAGCCTACGTGATCATTTCACAAAACCAAC
P-SETit.Rcc3-1:1:1:16   CTTAAAAAACATACAATGTTGTTCCAGCATCAAGCCTACGTGATCATTTCACAAAACCAAC
                        ************************************************************

P-SETit.Rcc3-1:1:1:1    TCAAAGATAGGTGTCATGTTCCTTTAGTGCAAAACTTAAGGACACCTACCTTGCAAAA
P-SETit.Rcc3-1:1:1:10   TCAAAGATAGGTGTCATGTTCCTTTAGTGCAAAACTTAAGGACACCTACCTTGCAAAA
P-SETit.Rcc3-1:1:1:11   TCAAAGATAGGTGTCATGTTCCTTTAGTGCAAAACTTAAGGACACCTACCTTGCAAAA
P-SETit.Rcc3-1:1:1:16   TCAAAGATAGGTGTCATGTTCCTTTAGTGCAAAACTTAAGGACACCTACCTTGCAAAA
                        ************************************************************
```

FIG. 10d

| | |
|---|---|
| P-SETit.Rcc3-1:1:1 | CTTAGCTTTGTTACCCAGAATGAACCGCTAAGCTCGAGGAGCTCTGAACTTACATGACCA |
| P-SETit.Rcc3-1:1:10 | CTTAGCTTTGTTACCCAGAATGAACCGCTAAGCTCGAGGAGCTCTGAACTTACATGACCA |
| P-SETit.Rcc3-1:1:11 | CTTAGCTTTGTTACCCAGAATGAACCGCTAAGCTCGAGGAGCTCTGAACTTACATGACCA |
| P-SETit.Rcc3-1:1:16 | CTTAGCTTTGTTACCCAGAATGAACCGCTAAGCTCGAGGAGCTCTGAACTTACATGACCA |
| | * * * * * * * * * * * * * * * * * * * * * * * * * * * * * * * * * * * * * * * * * * * * * * * * * * * * * * * * * * * * |
| P-SETit.Rcc3-1:1:1 | AATATATTAAACACAAAAGTCATGCATGATTTTCTTTAATAAGTATCGAGCAATATGGTT |
| P-SETit.Rcc3-1:1:10 | AATATATTAAACACAAAAGTCATGCATGATTTTCTTTAATAAGTATCGAGCAATATGGTT |
| P-SETit.Rcc3-1:1:11 | AATATATTAAACACAAAAGTCATGCATGATTTTCTTTAATAAGTATCGAGCAATATGGTT |
| P-SETit.Rcc3-1:1:16 | AATATATTAAACACAAAAGTCATGCATGATTTTCTTTAATAAGTATCGAGCAATATGGTT |
| | * * * * * * * * * * * * * * * * * * * * * * * * * * * * * * * * * * * * * * * * * * * * * * * * * * * * * * * * * * * * |
| P-SETit.Rcc3-1:1:1 | CGGGTGTCTTTCGTCTCATACCTCTATTGTCCTCCGTGATCAACAAGGGTGGATCCGGGT |
| P-SETit.Rcc3-1:1:10 | CGGGTGTCTTTCGTCTCATACCTCTATTGTCCTCCGTGATCAACAAGGGTGGATCCGGGT |
| P-SETit.Rcc3-1:1:11 | CGGGTGTCTTTCGTCTCATACCTCTATTGTCCTCCGTGATCAACAAGGGTGGATCCGGGT |
| P-SETit.Rcc3-1:1:16 | CGGGTGTCTTTCGTCTCATACCTCTATTGTCCTCCGTGATCAACAAGGGTGGATCCGGGT |
| | * * * * * * * * * * * * * * * * * * * * * * * * * * * * * * * * * * * * * * * * * * * * * * * * * * * * * * * * * * * * |
| P-SETit.Rcc3-1:1:1 | GGTGCAAGGGGCTCAAGCCCCTACCTCCCAAAGCGAGAAAGAAGGAGAAGAAGAGAAAGT |
| P-SETit.Rcc3-1:1:10 | GGTGCAAGGGGCTCAAGCCCCTACCTCCCAAAGCGAGAAAGAAGGAGAAGAAGAGAAAGT |
| P-SETit.Rcc3-1:1:11 | GGTGCAAGGGGCTCAAGCCCCTACCTCCCAAAGCGAGAAAGAAGGAGAAGAAGAGAAAGT |
| P-SETit.Rcc3-1:1:16 | GGTGCAAGGGGCTCAAGCCCCTACCTCCCAAAGCGAGAAAGAAGGAGAAGAAGAGAAAGT |
| | * * * * * * * * * * * * * * * * * * * * * * * * * * * * * * * * * * * * * * * * * * * * * * * * * * * * * * * * * * * * |
| P-SETit.Rcc3-1:1:1 | GAAGGAAGAAGAAACCCCCTATATTCTAATGCTACCTCCGCCACTGCTGATCAACACAAC |
| P-SETit.Rcc3-1:1:10 | GAAGGAAGAAGAAACCCCCTATATTCTAATGCTACCTCCGCCACTGCTGATCAACACAAC |
| P-SETit.Rcc3-1:1:11 | GAAGGAAGAAGAAACCCCCTATATTCTAATGCTACCTCCGCCACTGCTGATCAACACAAC |
| P-SETit.Rcc3-1:1:16 | GAAGGAAGAAGAAACCCCCTATATTCTAATGCTACCTCCGCCACTGCTGATCAACACAAC |
| | * * * * * * * * * * * * * * * * * * * * * * * * * * * * * * * * * * * * * * * * * * * * * * * * * * * * * * * * * * * * |
| P-SETit.Rcc3-1:1:1 | ATTCTTAAAACCATTCCTTGGCATTGCGCATGTTACAAGGTACAAAAGAGCCAGCCCA |
| P-SETit.Rcc3-1:1:10 | ATTCTTAAAACCATTCCTTGGCATTGCGCATGTTACAAGGTACAAAAGAGCCAGCCCA |
| P-SETit.Rcc3-1:1:11 | ATTCTTAAAACCATTCCTTGGCATTGCGCATGTTACAAGGTACAAAAGAGCCAGCCCA |
| P-SETit.Rcc3-1:1:16 | ATTCTTAAAACCATTCCTTGGCATTGCGCATGTTACAAGGTACAAAAGAGCCAGCCCA |
| | * * * * * * * * * * * * * * * * * * * * * * * * * * * * * * * * * * * * * * * * * * * * * * * * * * * * * * * * * * * * |

FIG. 10e

```
P-SETit.Rcc3-1:1:1    TATGCCAAGTTACTAAACTAAACTATGATCCACCATGGAGCGAGAACAAACGTCAACAGG
P-SETit.Rcc3-1:1:10   TATGCCAAGTTACTAAACTAAACTATGATCCACCATGGAGCGAGAACAAACGTCAACAGG
P-SETit.Rcc3-1:1:11   TATGCCAAGTTACTAAACTAAACTATGATCCACCATGGAGCGAGAACAAACGTCAACAGG
P-SETit.Rcc3-1:1:16   TATGCCAAGTTACTAAACTAAACTATGATCCACCATGGAGCGAGAACAAACGTCAACAGG
                      ************************************************************

P-SETit.Rcc3-1:1:1    CATCAACCAATGCAGCAATCTTGATCGCTAGTACTGTCCGGCATTATATCTGAAACAAAT
P-SETit.Rcc3-1:1:10   CATCAACCAATGCAGCAATCTTGATCGCTAGTACTGTCCGGCATTATATCTGAAACAAAT
P-SETit.Rcc3-1:1:11   CATCAACCAATGCAGCAATCTTGATCGCTAGTACTGTCCGGCATTATATCTGAAACAAAT
P-SETit.Rcc3-1:1:16   CATCAACCAATGCAGCAATCTTGATCGCTAGTACTGTCCGGCATTATATCTGAAACAAAT
                      ************************************************************

P-SETit.Rcc3-1:1:1    CCAGATCACCCATCTCATCACAGTCACATGCATTCATGGTCACGGGAACCGTTAGCAAAC
P-SETit.Rcc3-1:1:10   CCAGATCACCCATCTCATCACAGTCACATGCATTCATGGTCACGGGAACCGTTAGCAAAC
P-SETit.Rcc3-1:1:11   CCAGATCACCCATCTCATCACAGTCACATGCATTCATGGTCACGGGAACCGTTAGCAAAC
P-SETit.Rcc3-1:1:16   CCAGATCACCCATCTCATCACAGTCACATGCATTCATGGTCACGGGAACCGTTAGCAAAC
                      ************************************************************

P-SETit.Rcc3-1:1:1    CACCAACTAATCAGCATTGCAACACTCTTCCTCCTCCTATAAATGCAGCGAGCGGGGACACC
P-SETit.Rcc3-1:1:10   CACCAACTAATCAGCATTGCAACACTCTTCCTCCTCCTATAAATGCAGCGAGCGGGGACACC
P-SETit.Rcc3-1:1:11   CACCAACTAATCAGCATTGCAACACTCTTCCTCCTCCTATAAATGCAGCGAGCGGGGACACC
P-SETit.Rcc3-1:1:16   CACCAACTAATCAGCATTGCAACACTCTTCCTCCTCCTATAAATGCAGCGAGCGGGGACACC
                      ************************************************************

P-SETit.Rcc3-1:1:1    ATAAACCATCACAGGCACTTAG
P-SETit.Rcc3-1:1:10   ATAAACCATCACAGGCACTTAG
P-SETit.Rcc3-1:1:11   ATAAACCATCACAGGCACTTAG
P-SETit.Rcc3-1:1:16   ATAAACCATCACAGGCACTTAG
                      **********************
```

FIG. 10f

```
P-SETit.Sspl-1:1:1     TTCGCCCTTACTATAGGGCACGCGTGTCGACGGCCCGGGCTGGTATTCTACTGACCCAC
P-SETit.Sspl-1:1:2     --------------------------------------------------------

P-SETit.Sspl-1:1:1     GGTTCACTCGTATGTTATCCATCCAGTCAATTTTTCACGGATACCGCAAGCTTAACAGT
P-SETit.Sspl-1:1:2     --------------------------------------------------------

P-SETit.Sspl-1:1:1     GGGTGACTGTGTAGGTGATCACTTGGATTTTGGGGTGAGCACCTTGAGTCCACCCACAAA
P-SETit.Sspl-1:1:2     --------------------------------------------------------

P-SETit.Sspl-1:1:1     GGGTCTTATTATGCCAGTCTCAATAGTGGATTTCATGTGAGTTCATTAGCATTAAATTC
P-SETit.Sspl-1:1:2     --------------------------------------------------------

P-SETit.Sspl-1:1:1     TATGGTACATTAGCAATTTGCTAACTTGGCAGGATTATTAAGAGAGGAGAGAAAGTTTC
P-SETit.Sspl-1:1:2     --------------------------------------------------------

P-SETit.Sspl-1:1:1     ATTAGATGAGAGAGCAATTTCATCCCCATAAACCCATCAGACTCAGTGCAATGAAACTG
P-SETit.Sspl-1:1:2     --------------------------------------------------------

P-SETit.Sspl-1:1:1     TGCACGGAGATTGGCCTTAGAGGCTCTTGAATCACAATCGACCCGTCTTCCTACTGAAAA
P-SETit.Sspl-1:1:2     --------------------------------------------------------

P-SETit.Sspl-1:1:1     TTCTCCAGAATGCACGCTATCAGAAGAGGAGCCTCTAGTACCGTGGTTCGACTCTCCGTG
P-SETit.Sspl-1:1:2     --------------------------------------------------------

P-SETit.Sspl-1:1:1     GGAGCAAATTAAAGTGATCTAGAATAAAAAAATGTACAAAAAATAGGTTGGGTTTCTCCT
P-SETit.Sspl-1:1:2     --------------------------------------------------------

P-SETit.Sspl-1:1:1     ACTAACTTCAGTCAAAAAAAAGATAGCTAAACAAGATAGCTCTTGCGTTGAGTGTATGGA
P-SETit.Sspl-1:1:2     --------------------------------------------------------

P-SETit.Sspl-1:1:1     TAAAATTGAGTTGGCCCCGCCAGCTGCCTTCCCTTTCTTAGATTATGTTTGGGGTTCTTTC
P-SETit.Sspl-1:1:2     -----------------------------------------GGGTTCTTTTC
                                                                *********
```

FIG. 11a

```
P-SETit.Sspl-1:1:1   GTCATAGCGTATTTTCACTCAACAATGTGTCTCCTTATCCCTTTCATCCATGAGTAATG
P-SETit.Sspl-1:1:2   GTCATAGCGTATTTTCACTCAACAATGTGTCTCCTTATCCCTTTCATCCATGAGTAATG
                     ************************************************************

P-SETit.Sspl-1:1:1   GCTCTTGGAACATATCCTACTTTAGATAGGTGACAAATTCAGCTTAAAAGATTTAGATC
P-SETit.Sspl-1:1:2   GCTCTTGGAACATATCCTACTTTAGATAGGTGACAAATTCAGCTTAAAAGATTTAGATC
                     ************************************************************

P-SETit.Sspl-1:1:1   CACATCACCATATCACAACTTTACAGACTCTCTTAATAAAGTGGAATGCGTATGATGTG
P-SETit.Sspl-1:1:2   CACATCACCATATCACAACTTTACAGACTCTCTTAATAAAGTGGAATGCGTATGATGTG
                     ************************************************************

P-SETit.Sspl-1:1:1   ACCGATGCCTTCACATGTCTTATGGTGAACTTGTGATGATATTGTCACCCACGGTATCAA
P-SETit.Sspl-1:1:2   ACCGATGCCTTCACATGTCTTATGGTGAACTTGTGATGATATTGTCACCCACGGTATCAA
                     ************************************************************

P-SETit.Sspl-1:1:1   GAAAATACCAACAACAAGAAAAGTCACTTTTTCCTTTTATTAAGTGCATATTTGTTGCCAA
P-SETit.Sspl-1:1:2   GAAAATACCAACAACAAGAAAAGTCACTTTTTCCTTTTATTAAGTGCATATTTGTTGCCAA
                     ************************************************************

P-SETit.Sspl-1:1:1   CACATACCGTACAACCTAAGAAAATTAATCACTAAATGTTGAAATTGACTAGATACCATG
P-SETit.Sspl-1:1:2   CACATACCGTACAACCTAAGAAAATTAATCACTAAATGTTGAAATTGACTAGATACCATG
                     ************************************************************

P-SETit.Sspl-1:1:1   TCATGGCTTGGTTATCTAGATAATAATTTGCTTAGGAAAAGCAAAAATCATGCTAGAGCT
P-SETit.Sspl-1:1:2   TCATGGCTTGGTTATCTAGATAATAATTTGCTTAGGAAAAGCAAAAATCATGCTAGAGCT
                     ************************************************************

P-SETit.Sspl-1:1:1   ATATGATCTCTCAAGAGTATAAATAGGTCCCGGATATGTAGCCAATCT
P-SETit.Sspl-1:1:2   ATATGATCTCTCAAGAGTATAAATAGGTCCCGGATATGTAGCCAATCT
                     ************************************************
```

FIG. 11b

```
P-SETit.Tip-1:1:1   ------------------------------------------------------------
P-SETit.Tip-1:1:4   GACTTTTCACGCTGAGAAACTGTCAGGAAGCTCAAACAAACACAGCCTATACAGTGATTC

P-SETit.Tip-1:1:1   ------------------------------------------------------------
P-SETit.Tip-1:1:4   TGTACCAATCAAACCACTCACAACTCACCAATGTACCTGTTTATTTCCAAATCAACCAT

P-SETit.Tip-1:1:1   ------------------------------------------------------------
P-SETit.Tip-1:1:4   TGCTGTGGGGCTTGTGGGTTATGACTTATGAGTATGAGCAGTATTTCCCCCTGGAATG

P-SETit.Tip-1:1:1   ------------------------------------------------------------
P-SETit.Tip-1:1:4   CAAGTGGCAGATAGCTTCTGAGATCTACCATGCACCCTGGTAAAGCTCCTACCATTTTAT

P-SETit.Tip-1:1:1   ------------------------------------------------------------
P-SETit.Tip-1:1:4   TTGCAATAGTAGATGCATATAATTGATGGACACAGAGTTCTGAACCCGTGAGATTTCTTT

P-SETit.Tip-1:1:1   ------------------------------------------------------------
P-SETit.Tip-1:1:4   AACTTCAGAGTTCTGTCACTATGTTAACGTGGATCTGGAGTTTGCAGGAACTGTGAAGA

P-SETit.Tip-1:1:1   ------------------------------------------------------------
P-SETit.Tip-1:1:4   AGGAACCGTACCTAAAACTAAAAGTCTCACGAAGACCAAATGGGCAAGCCAGACAGTCAG

P-SETit.Tip-1:1:1   ------------------------------------------------------------
P-SETit.Tip-1:1:4   AGAGACAGGGCTTCTTCCGGCCAACTGGACAAGGATCTGCCATCATGTGCTGAGAGATTA

P-SETit.Tip-1:1:1   ------------------------------------------------------------
P-SETit.Tip-1:1:4   CCAAATCCGCAATTGCAGACGTGCCTTCTCAATCAGTTTGCACAAAGCGATAAGGTAAA

P-SETit.Tip-1:1:1   ------------------------------------------------------------
P-SETit.Tip-1:1:4   CAACCATTGGAGCATTGTTAACAGCCTAGCATGCAGGATGCGTCATCTGAATAATG

P-SETit.Tip-1:1:1   ------------------------------------------------------------
P-SETit.Tip-1:1:4   CGGAGGGCAGGACAGTAGGACAGGACACCTAATCCCTGCAAATTCTAGTGGCTCTGGGAC
```

FIG. 12a

```
P-SETit.Tip-1:1:1    ----------------------------------------------------
P-SETit.Tip-1:1:4    ACTGATCATGGCCCAAAAGTGCTAACCACTGCATTACTAAAACGTGTGGGTGTTGCGAGT

P-SETit.Tip-1:1:1    ----------------------------------------------------
P-SETit.Tip-1:1:4    TCCAAGTTGGCTGTTGTCATGGAATGGTATGAAAATGCAAAAGATTCTCGTTGTTTGTT

P-SETit.Tip-1:1:1    ----------------------------------------------------
P-SETit.Tip-1:1:4    GAGAGTTAGTAAATTGGGATGACTTCGGCATGACAACAGCACAAACCTTACATATTTGGT

P-SETit.Tip-1:1:1    ----------------------------------------------------
P-SETit.Tip-1:1:4    AAGACTTGCAACAAAAATCAAAAGAATGCTAGTAGATACCAACAAAAAGAAAAAACAGAG

P-SETit.Tip-1:1:1    ----------------------------------------------------
P-SETit.Tip-1:1:4    CTAGCATGAACACTTCTTTGATCACAGTTGATCAAAGGTGTATGGCCCTCAGACAAAGCT

P-SETit.Tip-1:1:1    ----------------------------------------------------
P-SETit.Tip-1:1:4    GTTGATGATGGTCAAACACTTTTGCTACCGAATATCGCAGTTGTCCTTTGGTACATTCAC

P-SETit.Tip-1:1:1    ----------------------------------------------------
P-SETit.Tip-1:1:4    AAGTTTGATCTTATCATCACCATCAGAAGTTCAGAAAGTCTCGATGAAAACAAATGGAAA

P-SETit.Tip-1:1:1    ----------------------------------------------------
P-SETit.Tip-1:1:4    TGAATACTGCTTACTTAGCTCAAATTCATATTCCGTTGTTACAGGATACTTAAAAAAGGT

P-SETit.Tip-1:1:1    ------------------------------------------------------TGTACTGTC
P-SETit.Tip-1:1:4    ACCAAAGGCTGTTCCTAATCATACGCTGAAGTCGTTGCCACCAATGGCAGCTGTACTGTC
                                                                            *********

P-SETit.Tip-1:1:1    ATATTGTCGTGGTTTTTCAATTGCTGTACCTGATGCAAACGTAATGGGTTTACTAATCTT
P-SETit.Tip-1:1:4    ATATTGTCGTGGTTTTTCAATTGCTGTACCTGATGCAAACGTAATGGGTTTACTAATCTT
                     ************************************************************
```

FIG. 12b

```
P-SETit.Tip-1:1:1    GCACCCGCCGGCTTCAAAATGAAGAGAGTGCTAATTTGGTCCACGTCACCATCACCGGTTCG
P-SETit.Tip-1:1:4    GCACCCGCCGACTTCAAAATGAAGAGAGTGCTAATTTGGTCCACGTCACCATCACCGGTTCG
                     ********** ***************************************************

P-SETit.Tip-1:1:1    AACTGTCTAGAATGGCAGGCAAAGATGATTGGACAGGCATGCAGGGAAAAAGAGCACCGT
P-SETit.Tip-1:1:4    AACTGTCTAGAATGGCAGGCAAAGATGATTGGACAGGCATGCAGGGAAAAAGAGCACCGA
                     *********************************************************** *

P-SETit.Tip-1:1:1    TGACGATGTATGCGAGTTCCCACCATTGCCGAGCAATGATTATCAGCCACACGACTTACTC
P-SETit.Tip-1:1:4    TGACGATGTATGCGAGTTCCCACCATTGCCGAGCAATGATTATCAGCCACACGACTTACTC
                     ************************************************************

P-SETit.Tip-1:1:1    TTCAGAGCTAACCACTGCCATGCAGAGAAAAAGTGAATCATATTGTCATGATCTACAACG
P-SETit.Tip-1:1:4    TTCAGAGCTAACCACTGCCATGCAGAGAAAAAGTGAATCATATTGTCATGATCTACAACG
                     ************************************************************

P-SETit.Tip-1:1:1    AAGTGAAACAATCAGGCATGCTAAAGTGCTGAAACTTTACTGATCTCTCATGTTGGACAA
P-SETit.Tip-1:1:4    AAGTGAAACAATCAGGCATGCTAAAGTGCTGAAACTTTACTGATCTCTCATGTTGGACAA
                     ************************************************************

P-SETit.Tip-1:1:1    CAAAGAATACGGGAATACATCAGCAACGCAACTCTTGAGCTTTGCTTGCCGAATGACCAG
P-SETit.Tip-1:1:4    CAAAGAATACGGGAATACATCAGCAACGCAACTCTTGAGCTTTGCTTGCTGAATGACCAG
                     ************************************************ **********

P-SETit.Tip-1:1:1    CTAGAATTTCCAAGCATTTACAGAAACATGACTTTAAGTTTCAGAAAAACAAATACAAGG
P-SETit.Tip-1:1:4    CTAGAATTTCCAAGCATTTACAGAAACATGACTTTAAGTTTCAGAAAAACAAATACAAGG
                     ************************************************************

P-SETit.Tip-1:1:1    CCACTAAATAAGCGTGGGGATAACATATCCTCCAGATGACAGGCAATCTGCAACTTGCAG
P-SETit.Tip-1:1:4    CCACTAAATAAGCGTGGGGATAACATATCCTCCAGATGACAGGCAATCTGCAACTTGCAG
                     ************************************************************

P-SETit.Tip-1:1:1    CCATTCAAATGTACGATTAACAAAATATTTAAGCGCCACATGAGATAATATATCCTCCAA
P-SETit.Tip-1:1:4    CCATTCAAATGTACGATTAACAAAATATTTAAGCGCTACATGAGATAATATATCCTCCAA
                     *********************************** ***********************
```

FIG. 12c

```
P-SETit.Tip-1:1:1    TTAGGGCCTTTAGTATTGTCATTAGCTCATAAACCATGGTGCATCCTCACATGGACGCTGC
P-SETit.Tip-1:1:4    TTAGGGCCTTTAGTATTGTCATTAGCTCATAAACCATGGTGCATCCTCACATGGACGCTGC
                     ************************************************************

P-SETit.Tip-1:1:1    ATAAGAAGTTCATAATAGCAACAGACATATGAACAAAGCATGGTGCGCCTGCCCGGCCGG
P-SETit.Tip-1:1:4    ATAAGAAGTTCATAATAGCAACAGACATATGAACAAAGCATGGTGCGCCTGCCCGGCCGG
                     ************************************************************

P-SETit.Tip-1:1:1    ACTAGCTAGTACTACCAATCATGGAATAAGCTAGTACCCTAAATGAAATTAAAATGGTTT
P-SETit.Tip-1:1:4    ACTAGCTAGTACTACCAATCATGGAATAAGCTAGTACCCTAAATGAAATTAAAATGGTTT
                     ************************************************************

P-SETit.Tip-1:1:1    TTAGCGATTATCCACGCCGTCCAGAATACTCTAATCCACAAGTTGAGGCCGCCCATGAAG
P-SETit.Tip-1:1:4    TTAGCGATTATCCACGCCGTCCAGAATACTCTAATCCACAAGTTGAGGCCGCCCATGAAG
                     ************************************************************

P-SETit.Tip-1:1:1    CCGCCGAGAGGGCGACGCCATGTGTATAAAAGGGGCCTAAGCTGAGTGGACTTGCTGCATC
P-SETit.Tip-1:1:4    CCGCCGAGAGGGCGACGCCATGTGTATAAAAGGGGCCTAAGCTGAGTGGACTTGCTGCATC
                     ************************************************************

P-SETit.Tip-1:1:1    AGATTAGT
P-SETit.Tip-1:1:4    AGATTAGT
                     ********
```

FIG. 12d

```
P-SETit.TubA2-1-1:1:2    TAGCGTAGCAGGCTAGCAGCCTGAACTCTCGGGTGATTCTGTGGCCGAGTTAGCTTGCTCG
P-SETit.TubA2-1-1:1:3    ------------------------------------------------------------

P-SETit.TubA2-1-1:1:2    CTGCCTGCAATGGAGTGAATATTGGCAGTACGAAGTCACACGGGCAGGCAGAGATTGGA
P-SETit.TubA2-1-1:1:3    ------------------------------------------------------------

P-SETit.TubA2-1-1:1:2    ACATGGTGGAAACAAGAACCATCGGCATCGTTCTTCTGATCAATATAGTGATTACTGGAA
P-SETit.TubA2-1-1:1:3    ------------------------------------------------------------

P-SETit.TubA2-1-1:1:2    GAATCAAGAACAGAATAAAACCAAGGCATCCTGGATCTACCATGTCAATCTTTGCTTTCA
P-SETit.TubA2-1-1:1:3    ------------------------------------------------------------

P-SETit.TubA2-1-1:1:2    TCCTCGTCGTTTGGAGCGAGCCTGTTCTTGTTTGAGGCGCGCTCGACCGTGCCACGAAGT
P-SETit.TubA2-1-1:1:3    ------------------------------------------------------------

P-SETit.TubA2-1-1:1:2    AACAGGTGCATGAGGTCTGCAGTCTGCACTAGAACTTCCCAGCTCCCAAATTCAACGAAA
P-SETit.TubA2-1-1:1:3    ------------------------------------------------------------

P-SETit.TubA2-1-1:1:2    CTGAAAAAGTCATTGGTAACATCAAAGTCTTGTCTTAGGATAGCTGCTGTTCTTGACGC
P-SETit.TubA2-1-1:1:3    ------------------------------------------------------------

P-SETit.TubA2-1-1:1:2    TGGTTAGATTTGTCCAATAAATTACATGACCAGCGCACATGTACTTGGTATTCGACTTGA
P-SETit.TubA2-1-1:1:3    ------------------------------------------------------------

P-SETit.TubA2-1-1:1:2    TGATTTGTATGTACTGACGGACTTGAATAAAGTAGGGGAATTAGGACTCAGAAGTCTAC
P-SETit.TubA2-1-1:1:3    ------------------------------------------------------------

P-SETit.TubA2-1-1:1:2    GATTTTTGGTCCAATATTTGATTGTGATGTTCAAAGTCGACGTCTCTTTCGAGACGAAAT
P-SETit.TubA2-1-1:1:3    ------------------------------------------------------------
```

FIG. 13a

```
P-SETit.TubA2-1-1:1:2    TGTGATGCGTAGAACAAAAACGACGCAATTTCTTTTCAAAAGAAAAAGATTAGGGGCAGA
P-SETit.TubA2-1-1:1:3    ------------------------------------------------------------

P-SETit.TubA2-1-1:1:2    ACAATTCAGGATCTCGTTTGGCTGGACTTATAAGCCGGCTGAAAAGCTGAAACGGTTGATT
P-SETit.TubA2-1-1:1:3    ------------------------------------------------------------

P-SETit.TubA2-1-1:1:2    TATTGTGAGAGAAAAACACTGTTTGGTGGCTGATAAGCTGAAACGAACAGGCTGTCAGTC
P-SETit.TubA2-1-1:1:3    ---ACTGTTTGGTGGCTGATAAGCTGAAACGAACAGGCTGTCAGTC
                            ******************************************

P-SETit.TubA2-1-1:1:2    ATTAGGCTGCCGCTCTGGAACAGTGCGCCATCAAGAGATCACCCGAACCATGTTGAGCT
P-SETit.TubA2-1-1:1:3    ATTAGGCTGCCGCTCTGGAACAGTGCGCCATCAAGAGATCACCCGAACCATGTTGAGCT
                         ************************************************************

P-SETit.TubA2-1-1:1:2    CATCAACGTGCCGCCGCTGTTGTGCTCATTGGTGTCGCGGTCGTCTGGCTGGCCGCATCTTT
P-SETit.TubA2-1-1:1:3    CATCAACGTGCCGCCGCTGTTGTGCTCATTGGTGTCGCGGTCGTCTGGCTGGCCGCATCTTT
                         ************************************************************

P-SETit.TubA2-1-1:1:2    CGTTGCGTCTTGTCATGGATTATCCACGACGGCAGTGTCCTGTTGTTTATGATGACGGCA
P-SETit.TubA2-1-1:1:3    CGTTGCGTCTTGTCATGGATTATCCACGACGGCAGTGTCCTGTTGTTTATGATGACGGCA
                         ************************************************************

P-SETit.TubA2-1-1:1:2    CTTGATTCGCCATGGATGGTGAAAACGAAATCGAAGTGCGGTCATTTTTATTTTACCAG
P-SETit.TubA2-1-1:1:3    CTTGATTCGCCATGGATGGTGAAAACGAAATCGAAGTGCGGTCATTTTTATTTTACCAG
                         ************************************************************

P-SETit.TubA2-1-1:1:2    ATGACGTGGTTGGTGACCTGAGAGGAACAGACATGAGAAGAAGATGAGATCAGCAGCTCAATT
P-SETit.TubA2-1-1:1:3    ATGACGTGGTTGGTGACCTGAGAGGAACAGACATGAGAAGAAGATGAGATCAGCAGCTCAATT
                         ************************************************************
```

FIG. 13b

```
P-SETit.TubA2-1-1:1:2   CCCACATTGACAGACGACCTTTGGAGCAGTACAAGAGACCCAAATGAAGAATAGTGCAAA
P-SETit.TubA2-1-1:1:3   CCCACATTGACAGACGACCTTTGGAGCAGTACAAGAGACCCAAATGAAGAATAGTGCAAA
                        ************************************************************

P-SETit.TubA2-1-1:1:2   TTACAGAGTATATTAGAACACGAGAATTATTAAGTTTTACTCGAGTCAATGAAAGAATT
P-SETit.TubA2-1-1:1:3   TTACAGAGTATATTAGAACACGAGAATTATTAAGTTTTACTCGAGTCAATGAAAGAATT
                        ***********************************************************

P-SETit.TubA2-1-1:1:2   TAGGACTATTCAGAGCACAGGCTGTGTTCAAGTCCTGCATGAACCAGAGAAAGTTCCCAC
P-SETit.TubA2-1-1:1:3   TAGGACTATTCAGAGCACAGGCTGTGTTCAAGTCCTGCATGAACCAGAGAAAGTTCCCAC
                        ************************************************************

P-SETit.TubA2-1-1:1:2   CAAGGCCTCCATCAGAGGAACGAATTTGCCTGGAACTCCATCACTCACCAGTCACCACTC
P-SETit.TubA2-1-1:1:3   CAAGGCCTCCATCAGAGGAACGAATTTGCCTGGAACTCCATCACTCACCAGTCACCACTC
                        ************************************************************

P-SETit.TubA2-1-1:1:2   ACCACTTACCAGCCTAATAAAGCGTAGCAGACAATTGGAGTAGACGATCATCATGTGCA
P-SETit.TubA2-1-1:1:3   ACCACTTACCAGCCTAATAAAGCGTAGCAGACAATTGGAGTAGACGATCATCATGTGCA
                        ***********************************************************

P-SETit.TubA2-1-1:1:2   GTCTCATAGGCCCTCTTCTAGGAATAACCGTATTTGATAGCCAATCCACCTATGTGGTGA
P-SETit.TubA2-1-1:1:3   GTCTCATAGGCCCTCTTCTAGGAATAACCGTATTTGATAGCCAATCCACCTATGTGGTGA
                        ************************************************************
```

FIG. 13c

```
P-SETit.TubA2-1-1:1:2    TTTTTTTTTCCTTTGTCCATCGGGGTCGCTTTCCATCCGACGTGTCTGCAGTGTAGCGCA
P-SETit.TubA2-1-1:1:3    TTTTTTTTTCCTTTGTCCATCGGGGTCGCTTTCCATCCGACGTGTCTGCAGTGTAGCGCA
                         ************************************************************

P-SETit.TubA2-1-1:1:2    ATCCATCTGTCGCTTTCTGCTTTCTGATGAACGTTCCGGTTGACGCCGCTAAGCTGCCTT
P-SETit.TubA2-1-1:1:3    ATCCATCTGTCGCTTTCTGCTTTCTGATGAACGTTCCGGTTGACGCCGCTAAGCTGCCTT
                         ************************************************************

P-SETit.TubA2-1-1:1:2    GTCCTCCTTTTCTCCCGTCTGCACAGGGAGGGG
P-SETit.TubA2-1-1:1:3    GTCCTCCTTTTCTCCCGTCTGCACAGGGAGGGG
                         *********************************
```

FIG. 13d

| | | |
|---|---|---|
| P-SETit.Ubq1-1:1:1 | ACTGCCGCGACACGCCTCACTGGCGGAGGGCTCCGAGCGCTCTCTCCCCGGCGGCCGGC | |
| P-SETit.Ubq1-1:1:3 | | |
| P-SETit.Ubq1-1:1:1 | GGAGCAGCGATCTGGATTGGAGAGAATAGAGGAAAGAGAGGGAAAAGGAGAGAGATAGCG | |
| P-SETit.Ubq1-1:1:3 | | |
| P-SETit.Ubq1-1:1:1 | CAAAGAGCTGAAAAGATAAGGTTGTGCGGGCTGTGTGATTAGAGGACCACTAATCCCTC | |
| P-SETit.Ubq1-1:1:3 | | |
| P-SETit.Ubq1-1:1:1 | CATCTCCTAATGACGCGGTGCCCAAGACCAGTGCCGCGGCACACCAGCGTCTAAGTGAAC | |
| P-SETit.Ubq1-1:1:3 | | |
| P-SETit.Ubq1-1:1:1 | TTCCGCTAACCTTCCGGTCATTGCGCCTGAAAGATGTCATGTGGCGAGGCCCCCTCTCA | |
| P-SETit.Ubq1-1:1:3 | | |
| P-SETit.Ubq1-1:1:1 | GTAGATTGCCAACTGCCTACCGTGCCACTCTTCCATGCATGATTGCTCCGTCTATCCCG | |
| P-SETit.Ubq1-1:1:3 | | |
| P-SETit.Ubq1-1:1:1 | TTTCTCACAACAGATAGACAACAGTAAGCATCACTAAAGCAAGCATGTGTAGAACCTTAA | |
| P-SETit.Ubq1-1:1:3 | | |
| P-SETit.Ubq1-1:1:1 | AAAAAGGCTTATACTACCAGTATACTATCAACCAGCATGCCGTTTTGAAGTATCCAGGA | |
| P-SETit.Ubq1-1:1:3 | | |
| P-SETit.Ubq1-1:1:1 | TTAGAAGCTTCTACTGCGCTTTTATATTATAGCTGTGGACCTGTGTGGTAACCTTTCTTT | |
| P-SETit.Ubq1-1:1:3 | | |
| P-SETit.Ubq1-1:1:1 | TGGCGCTTGCTTAAATCTCGGCCGTGCTGTCCATGCTTAGGCACTAGGCAGAGATAGAGC | |
| P-SETit.Ubq1-1:1:3 | | |
| P-SETit.Ubq1-1:1:1 | CGGGGGTGAATGGGGCTAAAGCTCAGCTGCTCGAGGGGCCGTGGGCTGTTTCCACTAGC | |
| P-SETit.Ubq1-1:1:3 | | |

FIG. 14a

```
P-SETit.Ubq1-1:1:1    CTACAGCTGTGCCACGTGCCGGCCCCGGCCAAGCCGAAGCAAGCACGCTGAGCCGTTGGACAG
P-SETit.Ubq1-1:1:3    ---------------------------------------------------------------

P-SETit.Ubq1-1:1:1    CTTGTCATAATGCCATTACGTGGATTACACGTAACTGCCCTGTAACTACTCGTTCGGCC
P-SETit.Ubq1-1:1:3    ---------------------------------------------------------------

P-SETit.Ubq1-1:1:1    ATCATCAAACGACGAGCGTCCGCTAGGCGACGACACGGGTAATGCACGCACCCAGGC
P-SETit.Ubq1-1:1:3    ----------------------------------CACGGGTAATGCACGCAGCCACCCAGGC
                                                        ************************

P-SETit.Ubq1-1:1:1    GCGCGCGCTAGCGGAGCACGGTCAGGTGACACGGGGCGTCGTGACGCTTCCGAGTTGAAGG
P-SETit.Ubq1-1:1:3    GCGCGCGCTAGCGGAGCACGGTCAGGTGACACGGGGCGTCGTGACGCTTCCGAGTTGAAGG
                      ************************************************************

P-SETit.Ubq1-1:1:1    GGTTAACGCCAGAAACAGTGTTTGGCCAGGTATGAACATAACAAAAATATTCACACGA
P-SETit.Ubq1-1:1:3    GGTTAACGCCAGAAACAGTGTTTGGCCAGGTATGAACATAACAAAAATATTCACACGA
                      ************************************************************

P-SETit.Ubq1-1:1:1    AAGAATGGAAGTATGGAGCTGCTACTGTGTAAATGCCAAGCAGGAAACTCACGCCCGCTA
P-SETit.Ubq1-1:1:3    AAGAATGGAAGTATGGAGCTGCTACTGTGTAAATGCCAAGCAGGAAACTCACGCCCGCTA
                      ************************************************************

P-SETit.Ubq1-1:1:1    ACATCCAACGGCCAACAGCTCGACGTGCCGGTCAGCAGAGCATCGGAACACTGGTGATTG
P-SETit.Ubq1-1:1:3    ACATCCAACGGCCAACAGCTCGACGTGCCGGTCAGCAGAGCATCGGAACACTGGTGATTG
                      ************************************************************
```

FIG. 14b

```
P-SETit.Ubq1-1:1:1    GTGGAGCCGGCAGTATGCGCCCCAGCACGGCCGAGGTGGTGGTGCCCGTGGCCCTGCTG
P-SETit.Ubq1-1:1:3    GTGGAGCCGGCAGTATGCGCCCCAGCACGGCCGAGGTGGTGGTGCCCGTGGCCCTGCTG
                      ***********************************************************

P-SETit.Ubq1-1:1:1    TCTGCGCGGCTCGGGACAACTTGAAACTGGGCCACCGCCTCGTCGCAACTCGCAACCCGT
P-SETit.Ubq1-1:1:3    TCTGCGCGGCTCGGGACAACTTGAAACTGGGCCACCGCCTCGTCGCAACTCGCAACCCGT
                      ************************************************************

P-SETit.Ubq1-1:1:1    TGGCGGAAGAAAGGAATGGCTCGTAGGGGCCCGGTAGAATCGAAGAATGTTGCGCTGGG
P-SETit.Ubq1-1:1:3    TGGCGGAAGAAAGGAATGGCTCGTAGGGGCCCGGTAGAATCGAAGAATGTTGCGCTGGG
                      **********************************************************

P-SETit.Ubq1-1:1:1    CTTCGATTCACATAACATGGGCCTGAAGCTCTAAAACGACGGCCCGGTCGCCGCGGCGATG
P-SETit.Ubq1-1:1:3    CTTCGATTCACATAACATGGGCCTGAAGCTCTAAAACGACGGCCCGGTCGCCGCGGCGATG
                      **************************************************************

P-SETit.Ubq1-1:1:1    GAAAGAGACCGGATCCTCCTCGTGAATTCTGGAAGGCCACACGAGAGCGACCACCACCG
P-SETit.Ubq1-1:1:3    GAAAGAGACCGGATCCTCCTCGTGAATTCTGGAAGGCCACACGAGAGCGACCACCACCG
                      ************************************************************

P-SETit.Ubq1-1:1:1    ACGCGGAGGAGTCGTGCTGGTGCCAACACGGCCGGGCTGGCTGCGACCTTAACCAG
P-SETit.Ubq1-1:1:3    ACGCGGAGGAGTCGTGCTGGTGCCAACACGGCCGGGCTGGCTGCGACCTTAACCAG
                      ************************************************************

P-SETit.Ubq1-1:1:1    CAAGGCACGCCACGACCCCGCCCCTCGAGGCATAAATACCCTCCCATCC
P-SETit.Ubq1-1:1:3    CAAGGCACGCCACGACCCCGCCCCTCGAGGCATAAATACCCTCCCATCC
                      *************************************************
```

FIG. 14c

PLANT REGULATORY ELEMENTS AND USES THEREOF

REFERENCE TO RELATED APPLICATIONS

This application is a 371 National Stage application of International Application No. PCT/US2011/021269, filed Jan. 14, 2011, which claims the benefit of U.S. Provisional Application No. 61/295,160 filed Jan. 14, 2010; 61/295,162 filed Jan. 14, 2010; 61/339,057 filed Feb. 26, 2010; 61/308,919 filed Feb. 27, 2010; 61/308,921 filed Feb. 27, 2010; and 61/331,924 filed May 6, 2010, all herein incorporated by reference in their entirety.

INCORPORATION OF SEQUENCE LISTING

The sequence listing that is contained in the file named "MONS279WO_ST25.txt", which is 1,194 KB (as measured in Microsoft Windows®) and was created on Jan. 11, 2011, is filed herewith by electronic submission and is incorporated by reference herein.

FIELD OF THE INVENTION

The invention relates to the field of plant molecular biology and plant genetic engineering and DNA molecules useful for modulating gene expression in plants, and for specifying intracellular or extracellular localization of a gene product.

BACKGROUND

Regulatory elements are genetic elements that regulate gene activity by modulating the transcription of an operably linked transcribable polynucleotide molecule. Such elements include promoters, leaders, introns, and 3' untranslated regions and are useful in the field of plant molecular biology and plant genetic engineering.

SUMMARY OF THE INVENTION

The present invention provides novel gene regulatory elements and transit peptide encoding sequences for use in plants. The present invention also provides DNA constructs comprising the regulatory elements and transit peptide encoding sequences. The present invention also provides transgenic plant cells, plants, and seeds comprising the regulatory elements and/or the transit peptide encoding sequences, operably linked to a transcribable polynucleotide molecule. The present invention also provides methods of making and using the regulatory elements, the DNA constructs comprising the regulatory elements, and the transgenic plant cells, plants, and seeds comprising the regulatory elements operably linked to a transcribable polynucleotide molecule.

Thus, in one aspect, the present invention provides a DNA molecule comprising a DNA sequence selected from the group consisting of a) a sequence with at least 85 percent sequence identity to any of SEQ ID NOs: 1-323 or SEQ ID NOs: 352-924; b) a sequence of any of SEQ ID NOs: 1-323 or SEQ ID NOs: 352-924; and c) a fragment of any of SEQ ID NOs: 1-323 or SEQ ID NOs: 352-924; wherein the fragment has gene regulatory activity or wherein the encoded peptide functions to localize an operably linked polypeptide within a cell; and wherein said sequence is operably linked to a heterologous transcribable polynucleotide molecule. In one embodiment, the sequence has at least 90 percent sequence identity to a DNA sequence selected from the group consisting of: SEQ ID NOs: 1-323 and SEQ ID NOS: 352-924. In another embodiment, the sequence has at least 95 percent sequence identity to a DNA sequence selected from the group consisting of: SEQ ID NOs: 1-323 and SEQ ID NOs: 352-924. In certain embodiments of the DNA molecule, the DNA sequence comprises a regulatory element. In some embodiments the regulatory element comprises a promoter. In particular embodiments, the heterologous transcribable polynucleotide molecule comprises a gene of agronomic interest, a gene capable of providing herbicide resistance in plants, or a gene capable of providing plant pest control in plants.

The invention also provides a plant cell comprising a DNA construct comprising a sequence of any of SEQ ID NOs: 1-323 or SEQ ID NOs: 352-924, or a fragment or variant thereof, wherein said sequence is operably linked to a heterologous transcribable polynucleotide molecule. In certain embodiments, the transgenic plant cell is a monocotyledonous plant cell. In other embodiments, the transgenic plant cell is a dicotyledonous plant cell.

Also included is a transgenic plant, or part thereof, comprising a DNA molecule comprising a DNA sequence selected from the group consisting of: a) a sequence with at least 85 percent sequence identity to any of SEQ ID NOs: 1-323 or SEQ ID NOs: 352-924; b) a sequence of any of SEQ ID NOs: 1-323 or SEQ ID NOs: 352-924; and c) a fragment of any of SEQ ID NOs: 1-323 or SEQ ID NOs: 352-924; wherein the fragment has gene regulatory activity or wherein the encoded peptide functions to localize an operably linked polypeptide within a cell; and wherein said sequence is operably linked to a heterologous transcribable polynucleotide molecule. In some embodiments a progeny plant of any generation of such a transgenic plant, or a part thereof, is provided. Further, a transgenic seed, wherein the seed comprises such a DNA molecule is also provided.

In another aspect, the invention provides a DNA molecule comprising a DNA sequence encoding a chloroplast transit peptide, wherein the protein sequence of the encoded transit peptide is selected from the group consisting of: a) a transit peptide protein sequence of any of SEQ ID NOs: 324-350; and b) a transit peptide protein sequence with at least 95 percent sequence identity to any of SEQ ID NOs: 324-350; wherein the chloroplast transit peptide-encoding DNA molecule is operably linked to a heterologous transcribable polynucleotide molecule. In some embodiments, such a DNA molecule comprises a DNA sequence encoding a chloroplast transit peptide, wherein the DNA sequence is selected from the group consisting of SEQ ID NOs: 277-284, 289-293, 296, 301-304 and 307-316. The present invention thus provides a DNA construct encoding such a chloroplast transit peptide.

Also provided by the invention is a transgenic plant cell comprising a DNA sequence encoding a chloroplast transit peptide, wherein the sequence of the chloroplast transit peptide is selected from the group consisting of SEQ ID NOs: 324-350. In some embodiments, the transgenic plant cell is a monocotyledonous plant cell. In other embodiments, the transgenic plant cell is a dicotyledonous plant cell. A transgenic plant, or part thereof, comprising the DNA molecule is also contemplated by the invention, as well as a progeny transgenic plant of any generation, or part thereof, of the transgenic plant; and a transgenic seed, each comprising the DNA molecule.

BRIEF DESCRIPTION OF THE FIGURES

FIGS. 1a-1c depict alignment of size variants corresponding to SEQ ID NOs:24-25 for the Foxtail Millet Actin 8 promoter.

FIGS. 2a-2c depict alignment of size variants corresponding to SEQ ID NOs:28-29 for the Foxtail Millet Alc1 promoter.

FIGS. 3a-3f depict alignment of size variants corresponding to SEQ ID NOs:45-46 for the Foxtail Millet Cys promoter.

FIGS. 4a-4f depict alignment of size variants corresponding to SEQ ID NOs:47-48 for the Foxtail Millet Dzs promoter.

FIGS. 5a-5c depict alignment of size variants corresponding to SEQ ID NOs:58-59 for the Foxtail Millet Gst promoter.

FIGS. 6a-6C depict alignment of size variants corresponding to SEQ ID NOs:60-61 for the Foxtail Millet Ifr promoter.

FIGS. 7a-7d depict alignment of size variants corresponding to SEQ ID NOs:64-65 for the Foxtail Millet Nrt2 promoter.

FIGS. 8a-8e depict alignment of size variants corresponding to SEQ ID NOs:74-75 for the Foxtail Millet Ppc promoter.

FIGS. 9a-9f depict alignment of size variants corresponding to SEQ ID NOs:82-83 for the Foxtail Millet Prx3 promoter.

FIGS. 10a-10f depict alignment of size variants corresponding to SEQ ID NOs:88-91 for the Foxtail millet Rcc3 promoter.

FIGS. 11a-11b depict alignment of size variants corresponding to SEQ ID NOs:93-94 for the Foxtail Millet Ssp1 promoter.

FIGS. 12a-12d depict alignment of size variants corresponding to SEQ ID NOs:96-97 for the Foxtail Millet Tip promoter.

FIGS. 13a-13d depict alignment of size variants corresponding to SEQ ID NOs:98-99 for the Foxtail Millet TubA2-1 promoter.

FIGS. 14a-14c depict alignment of size variants corresponding to SEQ ID NOs:102-103 for the Foxtail Millet Ubq1 promoter.

DETAILED DESCRIPTION OF THE INVENTION

Figure 15:
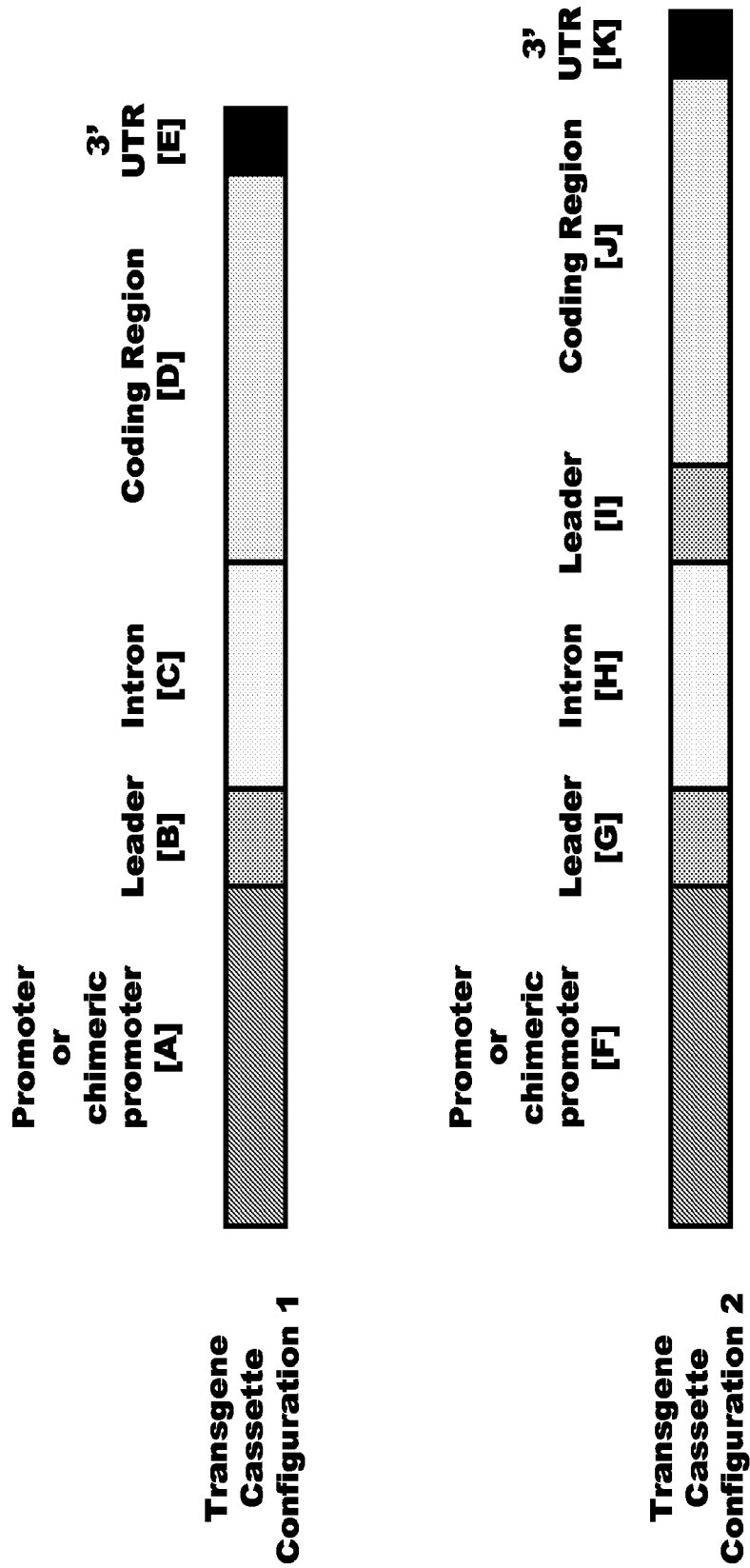
FIG. 15 depicts transgene cassette configurations of the present invention.

The invention disclosed herein provides polynucleotide molecules having beneficial gene regulatory or other activity from foxtail millet, *Setaria italica*. The design, construction, and use of these polynucleotide molecules are one object of this invention. The nucleotide sequences of these polynucleotide molecules are provided among SEQ ID NO: 1 through SEQ ID NO:323 and SEQ ID NO:352 through SEQ ID NO:1060. These polynucleotide molecules are, for instance, capable of affecting the expression of an operably linked transcribable polynucleotide molecule in plant tissues, or of effecting localization of an encoded gene product, and therefore can selectively regulate gene expression, or activity of an encoded gene product, in transgenic plants. The present invention also provides methods of modifying, producing, and using the same. The invention also includes compositions, transformed host cells, transgenic plants, and seeds containing the promoters and/or other disclosed *S. italica* nucleotide sequences, and methods for preparing and using the same.

The following definitions and methods are provided to better define the present invention and to guide those of ordinary skill in the art in the practice of the present invention. Unless otherwise noted, terms are to be understood according to conventional usage by those of ordinary skill in the relevant art.

DNA Molecules

As used herein, the term "DNA" or "DNA molecule" refers to a double-stranded DNA molecule of genomic or synthetic origin, i.e. a polymer of deoxyribonucleotide bases or a polynucleotide molecule, read from the 5' (upstream) end to the 3' (downstream) end. As used herein, the term "DNA sequence" refers to the nucleotide sequence of a DNA molecule. The nomenclature used herein is that required by Title 37 of the United States Code of Federal Regulations §1.822 and set forth in the tables in WIPO Standard ST.25 (1998), Appendix 2, Tables 1 and 3.

As used herein, the term "isolated DNA molecule" refers to a DNA molecule at least partially separated from other molecules normally associated with it in its native or natural state. In one embodiment, the term "isolated" refers to a DNA molecule that is at least partially separated from the nucleic acids which normally flank the DNA molecule in its native or natural state. Thus, DNA molecules fused to regulatory or coding sequences with which they are not normally associated, for example as the result of recombinant techniques, are considered isolated herein. Such molecules are considered isolated even when integrated into the chromosome of a host cell or present in a nucleic acid solution with other DNA molecules.

Any number of methods well known to those skilled in the art can be used to isolate and manipulate a DNA molecule, or fragment thereof, disclosed in the present invention. For example, PCR (polymerase chain reaction) technology can be used to amplify a particular starting DNA molecule and/or to produce variants of the original molecule. DNA molecules, or fragment thereof, can also be obtained by other techniques such as by directly synthesizing the fragment by chemical means, as is commonly practiced by using an automated oligonucleotide synthesizer.

As used herein, the term "sequence identity" refers to the extent to which two optimally aligned polynucleotide sequences or two optimally aligned polypeptide sequences are identical. An optimal sequence alignment is created by manually aligning two sequences, e.g. a reference sequence and another sequence, to maximize the number of nucleotide matches in the sequence alignment with appropriate internal nucleotide insertions, deletions, or gaps. As used herein, the term "reference sequence" refers to a sequence provided as the polynucleotide sequences of SEQ ID NOS: 1 through 323 and 352 through 924 or the polypeptide sequences of SEQ ID NOS: 324 through 350.

As used herein, the term "percent sequence identity" or "percent identity" or "% identity" is the identity fraction times 100. The "identity fraction" for a sequence optimally aligned with a reference sequence is the number of nucleotide matches in the optimal alignment, divided by the total number of nucleotides in the reference sequence, e.g. the total number of nucleotides in the full length of the entire reference sequence. Thus, one embodiment of the invention is a DNA molecule comprising a sequence that when optimally aligned to a reference sequence, provided herein as SEQ ID NOS: 1 through 323 and 352 through 924, has about 85 percent identity or higher, about 90 percent identity or higher, about 95 percent identity or higher, or at least 96 percent identity, 97 percent identity, 98 percent identity, or 99 percent identity to the reference sequence and has gene regulatory activity.

Regulatory Elements

A regulatory element is a DNA molecule having gene regulatory activity, i.e. one that has the ability to affect the transcription and/or translation of an operably linked transcribable polynucleotide molecule. The term "gene regulatory activity" thus refers to the ability to affect the expression pattern of an operably linked transcribable polynucleotide molecule by affecting the transcription and/or translation of that operably linked transcribable polynucleotide molecule. Gene regulatory activity may be positive and/or negative and the effect may be characterized by its temporal, spatial, developmental, tissue, environmental, physiological, pathological, cell cycle, and/or chemically responsive qualities as well as by quantitative or qualitative indications.

Regulatory elements such as promoters, leaders, introns, and transcription termination regions are DNA molecules that have gene regulatory activity and play an integral part in the overall expression of genes in living cells. The term "regulatory element" refers to a DNA molecule having gene regulatory activity, i.e. one that has the ability to affect the transcription and/or translation of an operably linked transcribable polynucleotide molecule. Isolated regulatory elements, such as promoters and leaders, that function in plants are therefore useful for modifying plant phenotypes through the methods of genetic engineering.

Regulatory elements may be characterized by their expression pattern, i.e. as constitutive and/or by their temporal, spatial, developmental, tissue, environmental, physiological, pathological, cell cycle, and/or chemically responsive expression pattern, and any combination thereof, as well as by quantitative or qualitative indications. A promoter is useful as a regulatory element for modulating the expression of an operably linked transcribable polynucleotide molecule.

As used herein, a "gene expression pattern" is any pattern of transcription of an operably linked DNA molecule into a transcribed RNA molecule. Expression may be characterized by its temporal, spatial, developmental, tissue, environmental, physiological, pathological, cell cycle, and/or chemically responsive qualities as well as by quantitative or qualitative indications. The transcribed RNA molecule may be translated to produce a protein molecule or may provide an antisense or other regulatory RNA molecule, such as a dsRNA, a tRNA, an rRNA, a miRNA, and the like.

As used herein, the term "protein expression is any pattern of translation of a transcribed RNA molecule into a protein molecule. Protein expression may be characterized by its temporal, spatial, developmental, or morphological qualities as well as by quantitative or qualitative indications.

As used herein, the term "promoter" refers generally to a DNA molecule that is involved in recognition and binding of RNA polymerase II and other proteins (trans-acting transcription factors) to initiate transcription. A promoter may be initially isolated from the 5' untranslated region (5' UTR) of a genomic copy of a gene. Alternately, promoters may be synthetically produced or manipulated DNA molecules. Promoters may also be chimeric, that is a promoter produced through the fusion of two or more heterologous DNA molecules. Promoters useful in practicing the present invention include SEQ ID NOS: 23 through 105 and SEQ ID NOS: 353 through 536 or fragments or variants thereof.

In one embodiment, fragments are provided of a promoter sequence disclosed herein. Promoter fragments may exhibit promoter activity, and may be useful alone or in combination with other promoters and promoter fragments, such as in constructing chimeric promoters. In specific embodiments, fragments of a promoter are provided comprising at least about 50, 95, 150, 250, 500, or about 750 contiguous nucleotides of a polynucleotide molecule having promoter activity disclosed herein.

A promoter or promoter fragment may also be analyzed for the presence of known promoter elements, i.e. DNA sequence characteristics, such as a TATA-box and other known transcription factor binding site motifs. Identification of such known promoter elements may be used by one of skill in the art to design variants of the promoter having a similar expression pattern to the original promoter.

As used herein, the term "enhancer" or "enhancer element" refers to a cis-acting transcriptional regulatory element, a.k.a. cis-element, which confers an aspect of the overall expression pattern, but is usually insufficient alone to drive transcription, of an operably linked polynucleotide sequence. Unlike promoters, enhancer elements do not usually include a transcription start site (TSS) or TATA box. A promoter may naturally comprise one or more enhancer elements that affect the transcription of an operably linked polynucleotide sequence. An isolated enhancer element may also be fused to a promoter to produce a chimeric promoter. cis-element, which confers an aspect of the overall modulation of gene expression. A promoter or promoter fragment may comprise one or more enhancer elements that effect the transcription of operably linked genes. Many promoter enhancer elements are believed to bind DNA-binding proteins and/or affect DNA topology, producing local conformations that selectively allow or restrict access of RNA polymerase to the DNA template or that facilitate selective opening of the double helix at the site of transcriptional initiation. An enhancer element may function to bind transcription factors that regulate transcription. Some enhancer elements bind more than one transcription factor, and transcription factors may interact with different affinities with more than one enhancer domain. Enhancer elements can be identified by a number of techniques, including deletion analysis, i.e. deleting one or more nucleotides from the 5' end or internal to a promoter; DNA binding protein analysis using DNase I footprinting, methylation interference, electrophoresis mobility-shift assays, in vivo genomic footprinting by ligation-mediated PCR, and other conventional assays; or by DNA sequence similarity analysis using known cis-element motifs or enhancer elements as a target sequence or target motif with conventional DNA sequence comparison methods, such as BLAST. The fine structure of an enhancer domain can be further studied by mutagenesis (or substitution) of one or more nucleotides or by other conventional methods. Enhancer elements can be obtained by chemical synthesis or by isolation from regulatory elements that include such elements, and they can be synthesized with additional flanking nucleotides that contain useful restriction enzyme sites to facilitate subsequence manipulation. Thus, the design, construction, and use of enhancer elements according to the methods disclosed herein for modulating the expression of operably linked transcribable polynucleotide molecules are encompassed by the present invention.

As used herein, the term "leader" refers to a DNA molecule isolated from the untranslated 5' region (5' UTR) of a genomic copy of a gene and defined generally as a nucleotide segment between the transcription start site (TSS) and the protein coding sequence start site. Alternately, leaders may be synthetically produced or manipulated DNA elements. A leader can be used as a 5' regulatory element for modulating expression of an operably linked transcribable polynucleotide molecule. Leader molecules may be used with a heterologous promoter or with their native promoter.

Promoter molecules of the present invention may thus be operably linked to their native leader or may be operably linked to a heterologous leader. Leaders useful in practicing the present invention include SEQ ID NOS: 106 through 171 and SEQ ID NOS: 537 through 588 or fragments or variants thereof.

As used herein, the term "chimeric" refers to a single DNA molecule produced by fusing a first DNA molecule to a second DNA molecule, where neither first nor second DNA molecule would normally be found in that configuration, i.e. fused to the other. The chimeric DNA molecule is thus a new DNA molecule not otherwise normally found in nature. As used herein, the term "chimeric promoter" refers to a promoter produced through such manipulation of DNA molecules. A chimeric promoter may combine two or more DNA fragments; an example would be the fusion of a promoter to an enhancer element. Thus, the design, construction, and use of chimeric promoters according to the methods disclosed herein for modulating the expression of operably linked transcribable polynucleotide molecules are encompassed by the present invention.

As used herein, the term "variant" refers to a second DNA molecule that is in composition similar, but not identical to, a first DNA molecule and yet the second DNA molecule still maintains the general functionality, i.e. same or similar expression pattern, of the first DNA molecule. A variant may be a shorter or truncated version of the first DNA molecule and/or an altered version of the sequence of the first DNA molecule, such as one with different restriction enzyme sites and/or internal deletions, substitutions, and/or insertions. A "variant" can also encompass a regulatory element having a nucleotide sequence comprising a substitution, deletion and/or insertion of one or more nucleotides of a reference sequence, wherein the derivative regulatory element has more or less or equivalent transcriptional or translational activity than the corresponding parent regulatory molecule. The regulatory element "variants" will also encompass variants arising from mutations that naturally occur in bacterial and plant cell transformation. In the present invention, a polynucleotide sequence provided as SEQ ID NOS: 1 through 325 and 352 through 924 may be used to create variants that are in composition similar, but not identical to, the polynucleotide sequence of the original regulatory element, while still maintaining the general functionality, i.e. same or similar expression pattern, of the original regulatory element. Production of such variants of the present invention is well within the ordinary skill of the art in light of the disclosure and is encompassed within the scope of the present invention. Chimeric regulatory element "variants" comprise the same constituent elements as a reference sequence but the constituent elements comprising the chimeric regulatory element may be operatively linked by various methods known in the art such as, restriction enzyme digestion and ligation, ligation independent cloning, modular assembly of PCR products during amplification, or direct chemical synthesis of the regulatory element as well as other methods known in the art. The resulting chimeric regulatory element "variant" can be comprised of the same, or variants of the same, constituent elements of the reference sequence but differ in the sequence or sequences that comprise the linking sequence or sequences which allow the constituent parts to be operatively linked. In the present invention, a polynucleotide sequence provided as SEQ ID NOS: 1 through 323 and 352 through 924 provide a reference sequence wherein the constituent elements that comprise the reference sequence may be joined by methods known in the art and may comprise substitutions, deletions and/or insertions of one or more nucleotides or mutations that naturally occur in bacterial and plant cell transformation.

Constructs

As used herein, the term "construct" means any recombinant polynucleotide molecule such as a plasmid, cosmid, virus, autonomously replicating polynucleotide molecule, phage, or linear or circular single-stranded or double-stranded DNA or RNA polynucleotide molecule, derived from any source, capable of genomic integration or autonomous replication, comprising a polynucleotide molecule where one or more polynucleotide molecule has been linked in a functionally operative manner, i.e. operably linked. As used herein, the term "vector" means any recombinant polynucleotide construct that may be used for the purpose of transformation, i.e. the introduction of heterologous DNA into a host cell.

As used herein, the term "operably linked" refers to a first molecule joined to a second molecule, wherein the molecules are so arranged that the first molecule affects the function of the second molecule. The two molecules may or may not be part of a single contiguous molecule and may or may not be adjacent. For example, a promoter is operably linked to a transcribable polynucleotide molecule if the promoter modulates transcription of the transcribable polynucleotide molecule of interest in a cell.

The constructs of the present invention are generally double Ti plasmid border DNA constructs that have the right border (RB or AGRtu.RB) and left border (LB or AGRtu.LB) regions of the Ti plasmid isolated from *Agrobacterium tumefaciens* comprising a T-DNA, that along with transfer molecules provided by the *A. tumefaciens* cells, permit the integration of the T-DNA into the genome of a plant cell (see, for example, U.S. Pat. No. 6,603,061). The constructs may also contain the plasmid backbone DNA segments that provide replication function and antibiotic selection in bacterial cells, for example, an *Escherichia coli* origin of replication such as ori322, a broad host range origin of replication such as oriV or oriRi, and a coding region for a selectable marker such as Spec/Strp that encodes for Tn7 aminoglycoside adenyltransferase (aadA) conferring resistance to spectinomycin or streptomycin, or a gentamicin (Gm, Gent) selectable marker gene. For plant transformation, the host bacterial strain is often *A. tumefaciens* ABI, C58, or LBA4404; however, other strains known to those skilled in the art of plant transformation can function in the present invention.

Methods are known in the art for assembling and introducing constructs into a cell in such a manner that the transcribable polynucleotide molecule is transcribed into a functional mRNA molecule that is translated and expressed as a protein product. For the practice of the present invention, conventional compositions and methods for preparing and using constructs and host cells are well known to one skilled in the art, see, for example, *Molecular Cloning: A Laboratory Manual*, $3^{rd}$ edition Volumes 1, 2, and 3 (2000) J. F. Sambrook, D. W. Russell, and N. Irwin, Cold Spring Harbor Laboratory Press. Methods for making recombinant vectors particularly suited to plant transformation include, without limitation, those described in U.S. Pat. Nos. 4,971, 908; 4,940,835; 4,769,061; and 4,757,011 in their entirety. These types of vectors have also been reviewed in the scientific literature (see, for example, Rodriguez, et al., *Vectors: A Survey of Molecular Cloning Vectors and Their Uses*, Butterworths, Boston, (1988) and Glick, et al., *Methods in Plant Molecular Biology and Biotechnology*, CRC Press, Boca Raton, Fla. (1993)). Typical vectors useful for expression of nucleic acids in higher plants are well known in the art and include vectors derived from the tumor-inducing (Ti) plasmid of *Agrobacterium tumefaciens* (Rogers, et al., *Methods in Enzymology* 153: 253-277 (1987)). Other recombinant vectors useful for plant transformation, including the pCaMVCN transfer control vector, have also been described in the scientific literature (see, for example, Fromm, et al., *Proc. Natl. Acad. Sci. USA* 82: 5824-5828 (1985)).

Various regulatory elements may be included in a construct. Any such regulatory elements may be provided in combination with other regulatory elements. Such combinations can be designed or modified to produce desirable regulatory features. Constructs of the present invention would typically comprise at least one regulatory element operably linked to a transcribable polynucleotide molecule operably linked to a 3' transcription termination molecule.

Constructs of the present invention may include any promoter or leader known in the art. For example, a promoter of the present invention may be operably linked to a heterologous non-translated 5' leader such as one derived from a heat shock protein gene (see, for example, U.S. Pat. Nos. 5,659,122 and 5,362,865). Alternatively, a leader of the present invention may be operably linked to a heterologous promoter such as the Cauliflower Mosaic Virus 35S transcript promoter (see, U.S. Pat. No. 5,352,605).

As used herein, the term "intron" refers to a DNA molecule that may be isolated or identified from the genomic copy of a gene and may be defined generally as a region spliced out during mRNA processing prior to translation. Alternately, an intron may be a synthetically produced or manipulated DNA element. An intron may contain elements enhancer elements that effect the transcription of operably linked genes. An intron may be used as a regulatory element for modulating expression of an operably linked transcribable polynucleotide molecule. A DNA construct may comprise an intron, and the intron may or may not be heterologous with respect to the transcribable polynucleotide molecule sequence. Examples of introns in the art include the rice actin intron (U.S. Pat. No. 5,641,876) and the corn HSP70 intron (U.S. Pat. No. 5,859,347). Introns useful in practicing the present invention include SEQ ID NOS: 172 through 267, SEQ ID NOS: 317 through 323 and SEQ ID NOS: 589 through 778.

As used herein, the term "3' transcription termination molecule" or "3' UTR" refers to a DNA molecule that is used during transcription to produce the 3' untranslated region (3' UTR) of an mRNA molecule. The 3' untranslated region of an mRNA molecule may be generated by specific cleavage and 3' polyadenylation, a.k.a. polyA tail. A 3' UTR may be operably linked to and located downstream of a transcribable polynucleotide molecule and may include polynucleotides that provide a polyadenylation signal and other regulatory signals capable of affecting transcription, mRNA processing, or gene expression. PolyA tails are thought to function in mRNA stability and in initiation of translation. Examples of 3' transcription termination molecules in the art are the nopaline synthase 3' region (see, Fraley, et al., *Proc. Natl. Acad. Sci. USA,* 80: 4803-4807 (1983)); wheat hsp17 3' region; pea rubisco small subunit 3' region; cotton E6 3' region (U.S. Pat. No. 6,096,950); 3' regions disclosed in WO0011200A2; and the coixin 3' UTR (U.S. Pat. No. 6,635,806). Sequences of 3' UTR regions useful in practicing the present invention are provided as SEQ ID NOS: 268 through 276 and SEQ ID NOS: 779 through 924.

3' UTRs are a basic prerequisite for the recombinant expression of specific genes. In animal systems, a machinery of 3' UTRs has been well defined (e.g. Zhao et al., *Microbiol Mol Biol Rev* 63:405-445 (1999); Proudfoot, *Nature* 322: 562-565 (1986); Kim et al., *Biotechnology Progress* 19:1620-1622 (2003); Yonaha and Proudfoot, *EMBO J.* 19:3770-3777 (2000); Cramer et al., *FEBS Letters* 498:179-182 (2001); Kuerstem and Goodwin, *Nature Reviews Genetics* 4:626-637 (2003)). Effective termination of RNA transcription is required to prevent unwanted transcription of trait-unrelated (downstream) sequences, which may interfere with trait performance (see below for more details). Arrangement of multiple gene expression cassettes in local proximity to one another (e.g. within one T-DNA) may cause suppression of gene expression of one or more genes in said construct in comparison to independent insertions (Padidam and Cao, *BioTechniques* 31:328-334 (2001)). This may interfere with achieving adequate levels of expression, for instance in cases were strong gene expression from all cassettes is desired.

In plants, clearly defined polyadenylation signal sequences are not known. Hasegawa et al., *Plant J.* 33:1063-1072, (2003)) were not able to identify conserved polyadenylation signal sequences in both in vitro and in vivo systems in *Nicotiana sylvestris* and to determine the actual length of the primary (non-polyadenylated) transcript. A weak 3' UTR has the potential to generate read-through, which may affect the expression of the genes located in the neighboring expression cassettes (Padidam and Cao, *BioTechniques* 31:328-334 (2001)). Appropriate control of transcription termination can prevent read-through into sequences (e.g. other expression cassettes) localized downstream and can further allow efficient recycling of RNA polymerase, to improve gene expression. Efficient termination of transcription (release of RNA Polymerase II from the DNA) is pre-requisite for re-initiation of transcription and thereby directly affects the overall transcript level. Subsequent to transcription termination, the mature mRNA is released from the site of synthesis and template to the cytoplasm. Eukaryotic mRNAs are accumulated as poly(A) forms in vivo, so that it is difficult to detect transcriptional termination sites by conventional methods. However, prediction of functional and efficient 3' UTRs by bioinformatics methods is difficult in that there are no conserved sequences which would allow easy prediction of an effective 3' UTR.

From a practical standpoint, it is preferred that a 3' UTR used in a transgene cassette possesses the following characteristics. The 3' UTR must be able to efficiently and effectively terminate transcription of the transgene and prevent read-through of the transcript into any neighboring DNA sequence which can be comprised of another transgene cassette as in the case of multiple cassettes residing in one T-DNA, or the neighboring chromosomal DNA into which the T-DNA has inserted. The 3' UTR should not cause a reduction in the transcriptional activity imparted by the promoter, leader and introns that are used to drive expression of the transgene. In plant biotechnology, the 3' UTR is often used for priming of amplification reactions of reverse transcribed RNA extracted from the transformed plant and used to (1) assess the transcriptional activity or expression of the transgene cassette once integrated into the plant chromosome; (2) assess the copy number of insertions within the plant DNA; and (3) assess zygosity of the resulting seed after breeding. The 3' UTR is also used in amplification reactions of DNA extracted from the transformed plant to characterize the intactness of the inserted cassette.

3' UTRs useful in providing expression of a transgene in plants are identified based upon the expression of expressed sequence tags (ESTs) in cDNA libraries made from messenger RNA isolated from seed, flower and other tissues derived from Foxtail millet (*Setaria italica* (L.) Beauv). Libraries of cDNA are made from tissues isolated from *S. italica* using methods known to those skilled in the art from flower tissue, seed, leaf and root. The resulting cDNAs are sequenced using various sequencing methods known in the art. The resulting ESTs are assembled into clusters using bioinformatics software such as clc_ref_assemble_complete version 2.01.37139 (CLC bio USA, Cambridge, Mass. 02142). Transcript abundance of each cluster is determined by counting the number of cDNA reads for each cluster. The identified 3' UTRs may be comprised of sequence derived from cDNA sequence as well as sequence derived from genomic DNA. The cDNA sequence is used to design primers, which are then used with GenomeWalker™ (Clontech Laboratories, Inc, Mountain View, Calif.) libraries constructed following the manufacturer's protocol to clone the 3' region of the corresponding genomic DNA sequence to provide a longer termination sequence. Analysis of relative transcript abundance either by direct counts or normalized counts of observed sequence reads for each tissue library can be used to infer properties about patters of expression. For example, some 3' UTRs may be found in transcripts seen in higher abundance in root tissue as opposed to leaf. This is suggestive that the transcript is highly expressed in root and that the properties of root expression may be attributable to the transcriptional regulation of the promoter, the lead, the introns or the 3' UTR. Empirical testing of 3' UTRs identified by the properties of expression within specific organs, tissues or cell types can result in the identification of 3' UTRs that enhance expression in those specific organs, tissues or cell types.

Constructs and vectors may also include a transit peptide coding sequence that expresses a linked peptide that is useful for targeting of a protein product, particularly to a chloroplast, leucoplast, or other plastid organelle; mitochondria; peroxisome; vacuole; or an extracellular location. For descriptions of the use of chloroplast transit peptides, see U.S. Pat. No. 5,188,642 and U.S. Pat. No. 5,728,925. Many chloroplast-localized proteins are expressed from nuclear genes as precursors and are targeted to the chloroplast by a chloroplast transit peptide (CTP). Examples of such isolated chloroplast proteins include, but are not limited to, those associated with the small subunit (SSU) of ribulose-1,5,-bisphosphate carboxylase, ferredoxin, ferredoxin oxidoreductase, the light-harvesting complex protein I and protein II, thioredoxin F, enolpyruvyl shikimate phosphate synthase (EPSPS), and transit peptides described in U.S. Pat. No. 7,193,133. It has been demonstrated in vivo and in vitro that non-chloroplast proteins may be targeted to the chloroplast by use of protein fusions with a heterologous CTP and that the CTP is sufficient to target a protein to the chloroplast. Incorporation of a suitable chloroplast transit peptide such as the *Arabidopsis thaliana* EPSPS CTP (CTP2) (See, Klee et al., *Mol. Gen. Genet.* 210:437-442 (1987)) or the *Petunia hybrida* EPSPS CTP (CTP4) (See, della-Cioppa et al., *Proc. Natl. Acad. Sci. USA* 83:6873-6877 (1986)) has been show to target heterologous EPSPS protein sequences to chloroplasts in transgenic plants (See, U.S. Pat. Nos. 5,627,061; 5,633,435; and 5,312,910 and EP 0218571; EP 189707; EP 508909; and EP 924299). Sequences encoding transit peptides useful for the present invention are provided as SEQ ID NOS: 277 through 316. Protein sequences of transit peptides useful for the present invention are provided as SEQ ID NOS: 324 through 350.

Transcribable Polynucleotide Molecules

As used herein, the term "transcribable polynucleotide molecule" refers to any DNA molecule capable of being transcribed into a RNA molecule, including, but not limited to, those having protein coding sequences and those having sequences useful for gene suppression. A "transgene" refers to a transcribable polynucleotide molecule heterologous to a host cell and/or a transcribable polynucleotide molecule artificially incorporated into a host cell's genome.

A promoter of the present invention may be operably linked to a transcribable polynucleotide molecule that is heterologous with respect to the promoter molecule. As used herein, the term "heterologous" refers to the combination of two or more polynucleotide molecules when such a combination would not normally be found in nature. For example, the two molecules may be derived from different species and/or the two molecules may be derived from different genes, e.g. different genes from the same species or the same genes from different species. A promoter is thus heterologous with respect to an operably linked transcribable polynucleotide molecule if such a combination is not normally found in nature, i.e. that transcribable polynucleotide molecule is not naturally occurring operably linked in combination with that promoter molecule.

The transcribable polynucleotide molecule may generally be any DNA molecule for which expression of an RNA transcript is desired. Such expression of an RNA transcript may result in translation of the resulting mRNA molecule and thus protein expression. Alternatively, a transcribable polynucleotide molecule may be designed to ultimately cause decreased expression of a specific gene or protein. This may be accomplished by using a transcribable polynucleotide molecule that is oriented in the antisense direction. One of ordinary skill in the art is familiar with using such antisense technology. Briefly, as the antisense transcribable polynucleotide molecule is transcribed, the RNA product hybridizes to and sequesters a complimentary RNA molecule inside the cell. This duplex RNA molecule cannot be translated into a protein by the cell's translational machinery and is degraded in the cell. Any gene may be negatively regulated in this manner.

Thus, one embodiment of the invention is a regulatory element of the present invention, such as those provided as SEQ ID NOS: 1 through 276, SEQ ID NOS: 317 through 323 and 352 through 924, operably linked to a transcribable polynucleotide molecule so as to modulate transcription of the transcribable polynucleotide molecule at a desired level or in a desired pattern upon introduction of said construct into a plant cell. In one embodiment, the transcribable polynucleotide molecule comprises a protein-coding region of a gene, and the promoter affects the transcription of an RNA molecule that is translated and expressed as a protein product. In another embodiment, the transcribable polynucleotide molecule comprises an antisense region of a gene, and the promoter affects the transcription of an antisense RNA molecule or other similar inhibitory RNA molecule in order to inhibit expression of a specific RNA molecule of interest in a target host cell.

Genes of Agronomic Interest

Transcribable polynucleotide molecules may be genes of agronomic interest. As used herein, the term "gene of agronomic interest" refers to a transcribable polynucleotide molecule that when expressed in a particular plant tissue, cell, or cell type provides a desirable characteristic associated with plant morphology, physiology, growth, development, yield, product, nutritional profile, disease or pest resistance, and/or environmental or chemical tolerance. Genes of agronomic interest include, but are not limited to, those encoding a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, a pesticidal protein, or any other agent such as an antisense or RNAi molecule targeting a particular gene for suppression. The product of a gene of agronomic interest may act within the plant in order to cause an effect upon the plant physiology or metabolism or may be act as a pesticidal agent in the diet of a pest that feeds on the plant.

In one embodiment of the invention, a promoter of the present invention is incorporated into a construct such that the promoter is operably linked to a transcribable polynucleotide molecule that is a gene of agronomic interest. The expression of the gene of agronomic interest is desirable in order to confer an agronomically beneficial trait. A beneficial agronomic trait may be, for example, but not limited to, herbicide tolerance, insect control, modified yield, fungal disease resistance, virus resistance, nematode resistance, bacterial disease resistance, plant growth and development, starch production, modified oils production, high oil production, modified fatty acid content, high protein production, fruit ripening, enhanced animal and human nutrition, biopolymers, environmental stress resistance, pharmaceutical peptides and secretable peptides, improved processing traits, improved digestibility, enzyme production, flavor, nitrogen fixation, hybrid seed production, fiber production, and biofuel production. Examples of genes of agronomic interest known in the art include those for herbicide resistance (U.S. Pat. Nos. 6,803,501; 6,448,476; 6,248,876; 6,225,114; 6,107,549; 5,866,775; 5,804,425; 5,633,435; and 5,463,175), increased yield (U.S. Pat. Nos. RE38,446; 6,716,474; 6,663,906; 6,476,295; 6,441,277; 6,423,828; 6,399,330; 6,372,211; 6,235,971; 6,222,098; and 5,716,837), insect control (U.S. Pat. Nos. 6,809,078; 6,713,063; 6,686,452; 6,657,046; 6,645,497; 6,642,030; 6,639,054; 6,620,988; 6,593,293; 6,555,655; 6,538,109; 6,537,756; 6,521,442; 6,501,009; 6,468,523; 6,326,351; 6,313,378; 6,284,949; 6,281,016; 6,248,536; 6,242,241; 6,221,649; 6,177,615; 6,156,573; 6,153,814; 6,110,464; 6,093,695; 6,063,756; 6,063,597; 6,023,013; 5,959,091; 5,942,664; 5,942,658, 5,880,275; 5,763,245; and 5,763,241), fungal disease resistance (U.S. Pat. Nos. 6,653,280; 6,573,361; 6,506,962; 6,316,407; 6,215,048; 5,516,671; 5,773,696; 6,121,436; 6,316,407; and 6,506,962), virus resistance (U.S. Pat. Nos. 6,617,496; 6,608,241; 6,015,940; 6,013,864; 5,850,023; and 5,304,730), nematode resistance (U.S. Pat. No. 6,228,992), bacterial disease resistance (U.S. Pat. No. 5,516,671), plant growth and development (U.S. Pat. Nos. 6,723,897 and 6,518,488), starch production (U.S. Pat. Nos. 6,538,181; 6,538,179; 6,538,178; 5,750,876; 6,476,295), modified oils production (U.S. Pat. Nos. 6,444,876; 6,426,447; and 6,380,462), high oil production (U.S. Pat. Nos. 6,495,739; 5,608,149; 6,483,008; and 6,476,295), modified fatty acid content (U.S. Pat. Nos. 6,828,475; 6,822,141; 6,770,465; 6,706,950; 6,660,849; 6,596,538; 6,589,767; 6,537,750; 6,489,461; and 6,459,018), high protein production (U.S. Pat. No. 6,380,466), fruit ripening (U.S. Pat. No. 5,512,466), enhanced animal and human nutrition (U.S. Pat. Nos. 6,723,837; 6,653,530; 6,5412,59; 5,985,605; and 6,171,640), biopolymers (U.S. Pat. Nos. RE37,543; 6,228,623; and 5,958,745 and 6,946,588), environmental stress resistance (U.S. Pat. No. 6,072,103), pharmaceutical peptides and secretable peptides (U.S. Pat. Nos. 6,812,379; 6,774,283; 6,140,075; and 6,080,560), improved processing traits (U.S. Pat. No. 6,476,295), improved digestibility (U.S. Pat. No. 6,531,648) low raffinose (U.S. Pat. No. 6,166,292), industrial enzyme production (U.S. Pat. No. 5,543,576), improved flavor (U.S. Pat. No. 6,011,199), nitrogen fixation (U.S. Pat. No. 5,229,114), hybrid seed production (U.S. Pat. No. 5,689,041), fiber production (U.S. Pat. Nos. 6,576,818; 6,271,443; 5,981,834; and 5,869,720) and biofuel production (U.S. Pat. No. 5,998,700).

Alternatively, a gene of agronomic interest can affect the above mentioned plant characteristic or phenotype by encoding a RNA molecule that causes the targeted modulation of gene expression of an endogenous gene, for example via antisense (see e.g. U.S. Pat. No. 5,107,065); inhibitory RNA ("RNAi", including modulation of gene expression via miRNA-, siRNA-, trans-acting siRNA-, and phased sRNA-mediated mechanisms, e.g. as described in published applications US 2006/0200878 and US 2008/0066206, and in U.S. patent application Ser. No. 11/974,469); or cosuppression-mediated mechanisms. The RNA could also be a catalytic RNA molecule (e.g. a ribozyme or a riboswitch; see e.g. US 2006/0200878) engineered to cleave a desired endogenous mRNA product. Thus, any transcribable polynucleotide molecule that encodes a transcribed RNA molecule that affects an agronomically important phenotype or morphology change of interest may be useful for the practice of the present invention. Methods are known in the art for constructing and introducing constructs into a cell in such a manner that the transcribable polynucleotide molecule is transcribed into a molecule that is capable of causing gene suppression. For example, posttranscriptional gene suppression using a construct with an anti-sense oriented transcribable polynucleotide molecule to regulate gene expression in plant cells is disclosed in U.S. Pat. Nos. 5,107,065 and 5,759,829, and posttranscriptional gene suppression using a construct with a sense-oriented transcribable polynucleotide molecule to regulate gene expression in plants is disclosed in U.S. Pat. Nos. 5,283,184 and 5,231,020. Expression of a transcribable polynucleotide in a plant cell can also be used to suppress plant pests feeding on the plant cell, for example, compositions isolated from coleopteran pests (U.S. Patent Publication No. US20070124836) and compositions isolated from nematode pests (U.S. Patent Publication No. US20070250947). Plant pests include, but are not limited to arthropod pests, nematode pests, and fungal or microbial pests. Exemplary transcribable polynucleotide molecules for incorporation into constructs of the present invention include, for example, DNA molecules or genes from a species other than the target species or genes that originate with or are present in the same species, but are incorporated into recipient cells by genetic engineering methods rather than classical reproduction or breeding techniques. The type of polynucleotide molecule can include, but is not limited to, a polynucleotide molecule that is already present in the plant cell, a polynucleotide molecule from another plant, a polynucleotide molecule from a different organism, or a polynucleotide molecule generated externally, such as a polynucleotide molecule containing an antisense message of a gene, or a polynucleotide molecule encoding an artificial, synthetic, or otherwise modified version of a transgene.

Selectable Markers

As used herein the term "marker" refers to any transcribable polynucleotide molecule whose expression, or lack thereof, can be screened for or scored in some way. Marker genes for use in the practice of the present invention include, but are not limited to transcribable polynucleotide molecules encoding β-glucuronidase (GUS described in U.S. Pat. No. 5,599,670), green fluorescent protein and variants thereof (GFP described in U.S. Pat. Nos. 5,491,084 and 6,146,826), proteins that confer antibiotic resistance, or proteins that confer herbicide tolerance. Useful antibiotic resistance markers, including those encoding proteins conferring resistance to kanamycin (nptII), hygromycin B (aph IV), streptomycin or spectinomycin (aad, spec/strep) and gentamycin (aac3 and aacC4) are known in the art. Herbicides for which transgenic plant tolerance has been demonstrated and the method of the present invention can be applied, include, but are not limited to: amino-methyl-phosphonic acid, glyphosate, glufosinate, sulfonylureas, imidazolinones, bromoxynil, delapon, dicamba, cyclohezanedione, protoporphyrinogen oxidase inhibitors, and isoxasflutole herbicides. Transcribable polynucleotide molecules encoding proteins involved in herbicide tolerance are known in the art, and include, but are not limited to, a transcribable polynucleotide molecule encoding 5-enolpyruvylshikimate-3-phosphate synthase (EPSPS for glyphosate tolerance described in U.S. Pat. Nos. 5,627,061; 5,633,435; 6,040,497; and 5,094,945); a transcribable polynucleotide molecule encoding a glyphosate oxidoreductase and a glyphosate-N-acetyl transferase (GOX described in U.S. Pat. No. 5,463,175; GAT described in U.S. Patent publication No. 20030083480, and dicamba monooxygenase U.S. Patent publication No. 20030135879); a transcribable polynucleotide molecule encoding bromoxynil nitrilase (Bxn for Bromoxynil tolerance described in U.S. Pat. No. 4,810,648); a transcribable polynucleotide molecule encoding phytoene desaturase (crtI) described in Misawa, et al., *Plant Journal* 4:833-840 (1993) and Misawa, et al., *Plant Journal* 6:481-489 (1994) for norflurazon tolerance; a transcribable polynucleotide molecule encoding acetohydroxyacid synthase (AHAS, aka ALS) described in Sathasiivan, et al., *Nucl. Acids Res.* 18:2188-2193 (1990) for tolerance to sulfonylurea herbicides; and the bar gene described in DeBlock, et al., *EMBO Journal* 6:2513-2519 (1987) for glufosinate and bialaphos tolerance. The promoter molecules of the present invention can express linked transcribable polynucleotide molecules that encode for phosphinothricin acetyltransferase, glyphosate resistant EPSPS, aminoglycoside phosphotransferase, hydroxyphenyl pyruvate dehydrogenase, hygromycin phosphotransferase, neomycin phosphotransferase, dalapon dehalogenase, bromoxynil resistant nitrilase, anthranilate synthase, aryloxyalkanoate dioxygenases, acetyl CoA carboxylase, glyphosate oxidoreductase, and glyphosate-N-acetyl transferase.

Included within the term "selectable markers" are also genes which encode a secretable marker whose secretion can be detected as a means of identifying or selecting for transformed cells. Examples include markers that encode a secretable antigen that can be identified by antibody interaction, or even secretable enzymes which can be detected catalytically. Selectable secreted marker proteins fall into a number of classes, including small, diffusible proteins which are detectable, (e.g. by ELISA), small active enzymes which are detectable in extracellular solution (e.g., alpha-amylase, beta-lactamase, phosphinothricin transferase), or proteins which are inserted or trapped in the cell wall (such as proteins which include a leader sequence such as that found in the expression unit of extension or tobacco pathogenesis related proteins also known as tobacco PR-S). Other possible selectable marker genes will be apparent to those of skill in the art and are encompassed by the present invention.

Cell Transformation

The invention is also directed to a method of producing transformed cells and plants which comprise a promoter operably linked to a transcribable polynucleotide molecule.

The term "transformation" refers to the introduction of nucleic acid into a recipient host. As used herein, the term "host" refers to bacteria, fungi, or plant, including any cells, tissue, organs, or progeny of the bacteria, fungi, or plant. Plant tissues and cells of particular interest include protoplasts, calli, roots, tubers, seeds, stems, leaves, seedlings, embryos, and pollen.

As used herein, the term "transformed" refers to a cell, tissue, organ, or organism into which a foreign polynucleotide molecule, such as a construct, has been introduced. The introduced polynucleotide molecule may be integrated into the genomic DNA of the recipient cell, tissue, organ, or organism such that the introduced polynucleotide molecule is inherited by subsequent progeny. A "transgenic" or "transformed" cell or organism also includes progeny of the cell or organism and progeny produced from a breeding program employing such a transgenic organism as a parent in a cross and exhibiting an altered phenotype resulting from the presence of a foreign polynucleotide molecule. The term "transgenic" refers to a bacteria, fungi, or plant containing one or more heterologous polynucleic acid molecules.

There are many methods for introducing polynucleic acid molecules into plant cells. The method generally comprises the steps of selecting a suitable host cell, transforming the host cell with a recombinant vector, and obtaining the transformed host cell. Suitable methods include bacterial infection (e.g. *Agrobacterium*), binary bacterial artificial chromosome vectors, direct delivery of DNA (e.g. via PEG-mediated transformation, desiccation/inhibition-mediated DNA uptake, electroporation, agitation with silicon carbide fibers, and acceleration of DNA coated particles, etc. (reviewed in Potrykus, et al., *Ann. Rev. Plant Physiol. Plant Mol. Biol.* 42: 205 (1991)).

Technology for introduction of a DNA molecule into cells is well known to those of skill in the art. Methods and materials for transforming plant cells by introducing a plant DNA construct into a plant genome in the practice of this invention can include any of the well-known and demonstrated methods including, but not limited to:

(1) chemical methods (Graham and Van der Eb, *Virology* 54:536-539 (1973) and Zatloukal, et al., *Ann. N.Y. Acad. Sci.* 660: 136-153 (1992));

(2) physical methods such as microinjection (Capecchi, *Cell* 22:479-488 (1980)), electroporation (Wong and Neumann, *Biochim. Biophys. Res. Commun.*, 107:584-587 (1982); Fromm, et al, *Proc. Natl. Acad. Sci. USA* 82:5824-5828 (1985); U.S. Pat. No. 5,384,253) particle acceleration (Johnston and Tang, *Methods Cell Biol.* 43(A):353-365 (1994); Fynan, et al., *Proc. Natl. Acad. Sci. USA* 90:11478-11482 (1993)): and microprojectile bombardment (as illustrated in U.S. Pat. Nos. 5,015,580; 5,550,318; 5,538,880; 6,160,208; 6,399,861; and 6,403,865);

(3) viral vectors (Clapp, *Clin. Perinatol.* 20:155-168 (1993); Lu, et al., *J. Exp. Med.* 178:2089-2096 (1993); Eglitis and Anderson, *Biotechniques* 6:608-614 (1988));

(4) receptor-mediated mechanisms (Curiel et al., *Hum. Gen. Ther.* 3:147-154 (1992) and Wagner, et al., *Proc. Natl. Acad. Sci. USA* 89:6099-6103 (1992); (5) bacterial mediated mechanisms such as *Agrobacterium*-mediated transformation (as illustrated in U.S. Pat. Nos. 5,824,877; 5,591,616; 5,981,840; and 6,384,301); direct introduction into pollen by injecting a plant's reproductive organs (Zhou, et al., *Methods in Enzymology* 101:433, (1983); Hess, *Intern Rev. Cytol.* 107:367

(1987); Luo, et al., *Plant Mol Biol. Reporter* 6:165 (1988); Pena, et al., *Nature* 325:274 (1987));

(7) protoplast transformation (as illustrated in U.S. Pat. No. 5,508,184); and (8) injection into immature embryos (Neuhaus, et al., *Theor. Appl. Genet.* 75:30 (1987)).

Any of the above described methods may be utilized to transform a host cell with one or more promoters and/or constructs of the present. Host cells may be any cell or organism such as a plant cell, algae cell, algae, fungal cell, fungi, bacterial cell, or insect cell. Preferred hosts and transformed cells include cells from: plants, *Aspergillus*, yeasts, insects, bacteria and algae.

Methods for transforming dicotyledonous plants, primarily by use of *Agrobacterium tumefaciens* and obtaining transgenic plants have been published for cotton (U.S. Pat. Nos. 5,004,863; 5,159,135; and 5,518,908); soybean (U.S. Pat. Nos. 5,569,834 and 5,416,011; see also, McCabe, et al., *Biotechnolgy* 6:923 (1988) and Christou et al., *Plant Physiol.* 87:671-674 (1988)); *Brassica* (U.S. Pat. No. 5,463,174); peanut (Cheng et al., *Plant Cell Rep.* 15:653-657 (1996) and McKently et al., *Plant Cell Rep.* 14:699-703 (1995)); papaya; and pea (Grant et al., *Plant Cell Rep.* 15:254-258 (1995)).

Transformations of monocotyledon plants using electroporation, particle bombardment, and *Agrobacterium* have also been reported. Transformation and plant regeneration have been achieved in asparagus (Bytebier, et al., *Proc. Natl. Acad. Sci. (USA)* 84:5354 (1987); barley (Wan and Lemaux, *Plant Physiol.* 104:37 (1994)); maize (Rhodes, et al., *Science* 240:204 (1988), Gordon-Kamm, et al., *Plant Cell* 2:603-618 (1990), Fromm, et al., *Bio/Technology,* 8:833 (1990), Koziel et al., *Bio/Technology* 11:194 (1993), and Armstrong, et al., *Crop Science* 35:550-557 (1995)); oat (Somers, et al., *Bio/Technology* 10:1589 (1992)); orchard grass (Horn, et al., *Plant Cell Rep.* 7:469 (1988)); rye (De la Pena, et al., *Nature,* 325:274 (1987)); sugarcane (Bower and Birch, *Plant Journal* 2:409 (1992)); tall fescue (Wang, et al., *Bio/Technology* 10:691 (1992)); and wheat (Vasil, et al., *Bio/Technology* 10:667 (1992) and U.S. Pat. No. 5,631,152).

The regeneration, development, and cultivation of plants from transformed plant protoplast or explants is well known in the art (see, for example, Weissbach and Weissbach, *Methods for Plant Molecular Biology,* (Eds.), Academic Press, Inc., San Diego, Calif. (1988) and Horsch et al., *Science* 227:1229-1231 (1985)). Transformed cells are generally cultured in the presence of a selective media, which selects for the successfully transformed cells and induces the regeneration of plant shoots and roots into intact plants (Fraley, et al., *Proc. Natl. Acad. Sci. U.S.A.* 80: 4803 (1983)). Transformed plants are typically obtained within two to four months.

The regenerated transgenic plants are self-pollinated to provide homozygous transgenic plants. Alternatively, pollen obtained from the regenerated transgenic plants may be crossed with non-transgenic plants, preferably inbred lines of agronomically important species. Descriptions of breeding methods that are commonly used for different traits and crops can be found in one of several reference books, see, for example, Allard, *Principles of Plant Breeding*, John Wiley & Sons, NY, U. of CA, Davis, Calif., 50-98 (1960); Simmonds, *Principles of crop improvement*, Longman, Inc., NY, 369-399 (1979); Sneep and Hendriksen, Plant breeding perspectives, Wageningen (ed), Center for Agricultural Publishing and Documentation (1979); Fehr, *Soybeans: Improvement, Production and Uses,* 2nd Edition, Monograph, 16:249 (1987); Fehr, *Principles of variety development, Theory and Technique,* (Vol. 1) and *Crop Species Soybean* (Vol 2), Iowa State Univ., Macmillan Pub. Co., NY, 360-376 (1987). Conversely, pollen from non-transgenic plants may be used to pollinate the regenerated transgenic plants.

The transformed plants may be analyzed for the presence of the genes of interest and the expression level and/or profile conferred by the regulatory elements of the present invention. Those of skill in the art are aware of the numerous methods available for the analysis of transformed plants. For example, methods for plant analysis include, but are not limited to Southern blots or northern blots, PCR-based approaches, biochemical analyses, phenotypic screening methods, field evaluations, and immunodiagnostic assays. The expression of a transcribable polynucleotide molecule can be measured using TaqMan® (Applied Biosystems, Foster City, Calif.) reagents and methods as described by the manufacturer and PCR cycle times determined using the TaqMan® Testing Matrix. Alternatively, the Invader® (Third Wave Technologies, Madison, Wis.) reagents and methods as described by the manufacturer can be used transgene expression.

The seeds of the plants of this invention can be harvested from fertile transgenic plants and be used to grow progeny generations of transformed plants of this invention including hybrid plant lines comprising the construct of this invention and expressing a gene of agronomic interest.

The present invention also provides for parts of the plants of the present invention. Plant parts, without limitation, include leaves, stems, roots, tubers, seeds, endosperm, ovule, and pollen. The invention also includes and provides transformed plant cells which comprise a nucleic acid molecule of the present invention.

The transgenic plant may pass along the transgenic polynucleotide molecule to its progeny. Progeny includes any regenerable plant part or seed comprising the transgene derived from an ancestor plant. The transgenic plant is preferably homozygous for the transformed polynucleotide molecule and transmits that sequence to all offspring as a result of sexual reproduction. Progeny may be grown from seeds produced by the transgenic plant. These additional plants may then be self-pollinated to generate a true breeding line of plants. The progeny from these plants are evaluated, among other things, for gene expression. The gene expression may be detected by several common methods such as western blotting, northern blotting, immunoprecipitation, and ELISA.

Having now generally described the invention, the same will be more readily understood through reference to the following examples which are provided by way of illustration, and are not intended to be limiting of the present invention, unless specified. It should be appreciated by those of skill in the art that the techniques disclosed in the following examples represent techniques discovered by the inventors to function well in the practice of the invention. However, those of skill in the art should, in light of the present disclosure, appreciate that many changes can be made in the specific embodiments that are disclosed and still obtain a like or similar result without departing from the spirit and scope of the invention, therefore all matter set forth or shown in the accompanying drawings is to be interpreted as illustrative and not in a limiting sense.

EXAMPLES

Regulatory elements useful to drive expression of an operably linked transcribable polynucleotide in transgenic plants were isolated, and the expression pattern of these regulatory elements operably linked to a transcribable polynucleotide molecule was analyzed in transgenic soy plants.

Example 1

Identification and Cloning of Novel Regulatory Elements: Promoters, Leaders and Introns Regulatory elements were identified and isolated from genomic DNA of the monocot species, Foxtail millet (*Setaria italica* (L.) Beauv). Proprietary genomic and EST and public genomic and EST sequence was used to design primers, which were then used with GenomeWalker™ (Clontech Laboratories, Inc, Mountain View, Calif.) libraries constructed following the manufacturer's protocol to clone the 5' region of the corresponding genomic DNA sequence. In the case of promoters leaders and introns, this cloned region comprised the 5' transcriptional regulatory, 5' UTR and if present, intron sequence upstream of the protein-coding region for each gene from *S. italica*. Using this sequence, regulatory elements were bioinformatically identified within the 5' region for each gene. Bioinformatic analysis was used to identify the transcriptional start site (TSS) and any bi-directionality, introns, or upstream coding sequence present in the sequence. Using the results of this analysis, regulatory elements were defined within the 5' sequence upstream of the coding sequence of the gene. Primers were then designed to amplify the regulatory elements. The corresponding DNA molecule for each regulatory element was amplified using standard polymerase chain reaction conditions with primers containing unique restriction enzyme sites and genomic DNA isolated from *S. italica*. The resulting DNA fragments were ligated into a base plant expression vector using standard restriction enzyme digestion of compatible restriction sites and DNA ligation methods.

Sequences of regulatory elements, transit peptide encoding elements and transit peptide protein sequences identified from *S. italica* are listed in Table 1 below. Sequences of the regulatory elements identified from *S. italica* are provided herein as SEQ ID NOS: 1 through 276, SEQ ID NOS: 317 through 323 and 352 through 924. Transcriptional regulatory element groups (EXP) comprised of a promoter, leader and intron operably linked or a promoter, leader, intron and leader operably linked are provided herein as SEQ ID NOS: 1 through 22. Promoter sequences are provided herein as SEQ ID NOS: 23 through 105 and SEQ ID NOS: 353 through 536. Leader sequences are provided herein as SEQ ID NOS: 106 through 171 and SEQ ID NOS: 537 through 588. Intron sequences are provided as SEQ ID NOS: 172 through 267, SEQ ID NOS: 317 through 323 and SEQ ID NOS: 589 through 778. Sequences comprising 3' UTRs are provided herein as SEQ ID NOS: 268 through 276 and SEQ ID NOS: 779 through 924. Sequences encoding transit peptides are provided herein as SEQ ID NOS: 277 through 316. The genomic DNA encoding some of the transit peptides also are comprised by introns presented as SEQ ID NOS: 317 through 323. Transit peptide protein sequences are provided herein as SEQ ID NOS: 324 through 350. An enhancer element is provided as SEQ ID NO: 352.

TABLE 1

Regulatory elements and corresponding promoters, leaders and introns; and transit (localization) sequences.

| Annotation | SEQ ID NO: | Description |
|---|---|---|
| EXP-FMV.35S-SETit.Ccoamt | 1 | Enhanced Caffeoyl CoA methyltransferase |
| EXP-FMV.35S-SETit.Gst:a | 2 | Enhanced Glutathione S-transferase |
| EXP-FMV.35S-SETit.Gst:b | 3 | Enhanced Glutathione S-transferase |
| EXP-FMV.35S-SETit.Ifr | 4 | Enhanced Isoflavone Reducatase |
| EXP-FMV.35S-SETit.Pox | 5 | Enhanced Peroxidase |
| EXP-FMV.35S-SETit.Rcc3:a | 6 | Enhanced Lipid Transfer Protein-RCc3 |
| EXP-FMV.35S-SETit.Rcc3:b | 7 | Enhanced Lipid Transfer Protein-RCc3 |
| EXP-FMV.35S-SETit.Tip | 8 | Enhanced Tonoplast intrinsic protein |
| EXP-SETit.Act8:1:1 | 9 | Actin 8 |
| EXP-SETit.Act8:1:2 | 10 | Actin 8 |
| EXP-SETit.Act8:c | 11 | Actin 8-1 |
| EXP-SETit.CLUS120796-1 | 12 | Cluster 120796-1 |
| EXP-SETit.CLUS19108 | 13 | Cluster 19108 |
| EXP-SETit.Ppdk:1:1 | 14 | Pyruvate orthophosphate dikinase |
| EXP-SETit.TubA2:1:1 | 15 | Tubulin A2 |
| EXP-SETit.TubA2:1:3 | 16 | Tubulin A2 |
| EXP-SETit.TubA2-1:1:2 | 17 | Tubulin A2-1 |
| EXP-SETit.TubA2-2:1:1 | 18 | Tubulin A2-2 |
| EXP-SETit.TubA3:1:3 | 19 | Tubulin A3 |
| EXP-SETit.Ubq1:1:1 | 20 | Ubiquitin 1 |
| EXP-SETit.Ubq1:1:3 | 21 | Ubiquitin 1 |
| EXP-SETit.Ubq5 | 22 | Ubiquitin 5 |
| P-SETit.25509-1:1:3 | 23 | Cluster 25509 |
| P-SETit.Act8-1:1:5 | 24 | Actin 8 |
| P-SETit.Act8-1:1:6 | 25 | Actin 8 |
| P-SETit.Act8-1-1:1:2 | 26 | Actin 8-1 |
| P-SETit.Aip-1:1:1 | 27 | Auxin-induced protein |
| P-SETit.Alc1-1:1:1 | 28 | Alpha-coixin |
| P-SETit.Alc1-1:1:2 | 29 | Alpha-coixin |
| P-SETit.Alc2-1:1:2 | 30 | Alpha-coixin |
| P-SETit.Ali1-1:1:3 | 31 | Aluminum-induced protein |
| P-SETit.Cab1-1:1:1 | 32 | Chlorophyll a/b binding protein-1 |
| P-SETit.Cab3-1:1:3 | 33 | Chlorophyll a/b binding protein-3 |
| P-SETit.Cbl7-1:1:1 | 34 | Calcineurin B-like protein |
| P-SETit.Ccoamt-1:1:2 | 35 | Cafeoyl CoA methyltransferase |
| P-SETit.Cda-1:1:1 | 36 | Cell death associated protein |

TABLE 1-continued

Regulatory elements and corresponding promoters, leaders and introns; and transit (localization) sequences.

| Annotation | SEQ ID NO: | Description |
|---|---|---|
| P-SETit.CLUS1164825-1-1:1:1 | 37 | Cluster 1164825-1 |
| P-SETit.CLUS1165324-1-1:1:1 | 38 | Cluster 1165324-1 |
| P-SETit.CLUS120796-1-1:1:1 | 39 | Cluster 120796-1 |
| P-SETit.CLUS19108-1:1:2 | 40 | Cluster 19108 |
| P-SETit.CLUS882664-1-1:1:2 | 41 | Cluster 882664-1 |
| P-SETit.CP29-1:1:4 | 42 | Chloroplast protein-29 |
| P-SETit.Cyp-1-1:1:1 | 43 | Cysteine protease-1 |
| P-SETit.Cyp78a-1:1:2 | 44 | Cysteine protease-78a |
| P-SETit.Cys-1:1:2 | 45 | Cysteine synthase |
| P-SETit.Cys-1:1:3 | 46 | Cysteine synthase |
| P-SETit.Dzs-1:1:4 | 47 | Delta zein storage protein |
| P-SETit.Dzs-1:1:5 | 48 | Delta zein storage protein |
| P-SETit.Eie-1:1:1 | 49 | Elongation Factor |
| P-SETit.EST CLUS675389-2-1:1:2 | 50 | Cluster 675389-2 |
| P-SETit.Fba-1:1:1 | 51 | Fructose-bisphosphate aldolase |
| P-SETit.FM54-1:1:2 | 52 | Cluster 1102871_1 |
| P-SETit.FM63-1:1:2 | 53 | Cluster 1019870_1 |
| P-SETit.Fst-1:1:1 | 54 | Flavonol 4-sulfotransferase |
| P-SETit.Gapdh2-1:1:3 | 55 | Glyceraldehyde-3-phosphate dehydrogenase |
| P-SETit.Grcw2-1:1:1 | 56 | Glycine-rich cell wall structural protein 2 |
| P-SETit.Grf-1:1:2 | 57 | Putative growth-regulating factor |
| P-SETit.Gst-1:1:1 | 58 | Glutathione S-transferase |
| P-SETit.Gst-1:1:2 | 59 | Glutathione S-transferase |
| P-SETit.Ifr-1:1:2 | 60 | Isoflavone Reducatase |
| P-SETit.Ifr-1:1:3 | 61 | Isoflavone Reducatase |
| P-SETit.LaDo-1:1:2 | 62 | leucoanthocianidin dioxygenase |
| P-SETit.Mt1-1:1:2 | 63 | Metallothionein-like protein 1 |
| P-SETit.Nrt2-1:1:2 | 64 | Nitrate transporter-like protein |
| P-SETit.Nrt2-1:1:3 | 65 | Nitrate transporter-like protein |
| P-SETit.OMT2.1-1:1:2 | 66 | O-methyltransferase-2.1 |
| P-SETit.OMT2.2-1:1:2 | 67 | O-methyltransferase-2.2 |
| P-SETit.OMT2.3-1:1:1 | 68 | O-methyltransferase-2.3 |
| P-SETit.Omt3-1:1:3 | 69 | O-methyltransferase-3 |
| P-SETit.Omt4_2-1:1:2 | 70 | O-methyltransferase-4.2 |
| P-SETit.Pip2-1:1:3 | 71 | Aquaporin |
| P-SETit.Pip2-3-1:1:1 | 72 | Aquaporin |
| P-SETit.Pox-1:1:1 | 73 | Peroxidase 1 |
| P-SETit.Ppc-1:1:3 | 74 | Phosphoenolpyruvate carboxylase |
| P-SETit.Ppc-1:1:4 | 75 | Phosphoenolpyruvate carboxylase |
| P-SETit.Ppdk-1:1:1 | 76 | Pyruvate orthophosphate dikinase |
| P-SETit.Pro1-1:1:2 | 77 | Prolamin |
| P-SETit.Pro2-1:1:3 | 78 | Prolamin |
| P-SETit.Prx-1:1:1 | 79 | Peroxidase |
| P-SETit.Prx17-1:1:2 | 80 | Peroxidase-17 |
| P-SETit.Prx2-1:1:3 | 81 | Peroxidase-2 |
| P-SETit.Prx3-1:1:3 | 82 | Peroxidase-3 |
| P-SETit.Prx3-1:1:4 | 83 | Peroxidase-3 |
| P-SETit.Prx47-1:1:2 | 84 | Peroxidase-47 |
| P-SETit.Prx72-1:1:2 | 85 | Peroxidase-72 |
| P-SETit.PSI-4a-1:1:1 | 86 | Photosystem 1 4a |
| P-SETit.Rbcs-1:1:1 | 87 | Small subunit RUBISCO |
| P-SETit.Rcc3-1:1:1 | 88 | Lipid Transfer Protein-RCc3 |
| P-SETit.Rcc3-1:1:10 | 89 | Lipid Transfer Protein-RCc3 |
| P-SETit.Rcc3-1:1:11 | 90 | Lipid Transfer Protein-RCc3 |
| P-SETit.Rcc3-1:1:16 | 91 | Lipid Transfer Protein-RCc3 |
| P-SETit.Srp-1:1:2 | 92 | Stress responsive protein |
| P-SETit.Ssp1-1:1:1 | 93 | Seed storage protein |
| P-SETit.Ssp1-1:1:2 | 94 | Seed storage protein |
| P-SETit.Tga6-1:1:2 | 95 | Teosinte glume architecture |
| P-SETit.Tip-1:1:1 | 96 | Tonoplast intrinsic protein |
| P-SETit.Tip-1:1:4 | 97 | Tonoplast intrinsic protein |
| P-SETit.TubA2-1-1:1:2 | 98 | Tubulin A2-1 |
| P-SETit.TubA2-1-1:1:3 | 99 | Tubulin A2-1 |
| P-SETit.TubA2-2-1:1:3 | 100 | Tubulin A2-2 |
| P-SETit.TubA3-1:1:3 | 101 | Tubulin A3 |
| P-SETit.Ubq1-1:1:1 | 102 | Ubiquitin 1 |
| P-SETit.Ubq1-1:1:3 | 103 | Ubiquitin 1 |
| P-SETit.Ubq5-1:1:2 | 104 | Ubiquitin 5 |
| P-SETit.Ucc1-1:1:2 | 105 | Uclacyanin |
| L-SETit.Act8-1:1:2 | 106 | Actin 8 |
| L-SETit.Act8-1:1:3 | 107 | Actin 8 |
| L-SETit.Act8-1:1:4 | 108 | Actin 8-1 |
| L-SETit.Aip-1:1:1 | 109 | Auxin-induced protein |

TABLE 1-continued

Regulatory elements and corresponding promoters, leaders and introns; and transit (localization) sequences.

| Annotation | SEQ ID NO: | Description |
|---|---|---|
| L-SETit.Alc1-1:1:1 | 110 | Alpha-coixin |
| L-SETit.Alc2-1:1:1 | 111 | Alpha-coixin |
| L-SETit.Ali1-1:1:1 | 112 | Aluminum-induced protein |
| L-SETit.Cab1-1:1:1 | 113 | Chlorophyll a/b binding protein-1 |
| L-SETit.Cab3-1:1:1 | 114 | Chlorophyll a/b binding protein-3 |
| L-SETit.Cbl7-1:1:1 | 115 | Calcineurin B-like protein |
| L-SETit.Ccoamt-1:1:2 | 116 | Cafeoyl CoA methyltransferase |
| L-SETit.Cda-1:1:1 | 117 | Cell death associated protein |
| L-SETit.CLUS1164825-1-1:1:1 | 118 | Cluster 1164825-1 |
| L-SETit.CLUS120796-1-1:1:1 | 119 | Cluster 120796-1 |
| L-SETit.CLUS120796-1-1:1:2 | 120 | Cluster 120796-1 |
| L-SETit.CLUS19108-1:1:1 | 121 | Cluster 19108 |
| L-SETit.CLUS19108-1:1:2 | 122 | Cluster 19108 |
| L-SETit.CLUS882664-1-1:1:1 | 123 | Cluster 882664-1 |
| L-SETit.CP29-1:1:1 | 124 | Chloroplast protein-29 |
| L-SETit.Cyp-1-1:1:1 | 125 | Cysteine protease-1 |
| L-SETit.Cyp78a-1:1:1 | 126 | Cysteine protease-78a |
| L-SETit.Cys-1:1:1 | 127 | Cysteine synthase |
| L-SETit.Dzs-1:1:1 | 128 | Delta zein storage protein |
| L-SETit.Eie-1:1:1 | 129 | Elongation Factor |
| L-SETit.EST CLUS675389-2-1:1:1 | 130 | Cluster 675389-2 |
| L-SETit.Fba-1:1:1 | 131 | Fructose-bisphosphate aldolase |
| L-SETit.Fst-1:1:1 | 132 | Flavonol 4-sulfotransferase |
| L-SETit.Gapdh2-1:1:1 | 133 | Glyceraldehyde-3-phosphate dehydrogenase |
| L-SETit.Grcw2-1:1:1 | 134 | Glycine-rich cell wall structural protein 2 |
| L-SETit.Gst-1:1:1 | 135 | Glutathione S-transferase |
| L-SETit.Ifr-1:1:1 | 136 | Isoflavone Reducatase |
| L-SETit.LaDo-1:1:1 | 137 | leucoanthocianidin dioxygenase |
| L-SETit.Mt1-1:1:1 | 138 | Metallothionein-like protein 1 |
| L-SETit.Nrt2-1:1:2 | 139 | Nitrate transporter-like protein |
| L-SETit.OMT2.1-1:1:1 | 140 | O-methyltransferase-2.1 |
| L-SETit.OMT2.2-1:1:1 | 141 | O-methyltransferase-2.2 |
| L-SETit.OMT2.2-1:1:2 | 142 | O-methyltransferase-2.3 |
| L-SETit.Omt3-1:1:1 | 143 | O-methyltransferase-3 |
| L-SETit.Omt4_2-1:1:1 | 144 | O-methyltransferase-4.2 |
| L-SETit.Pip2-1:1:1 | 145 | Aquaporin |
| L-SETit.Pip2-3-1:1:1 | 146 | Aquaporin |
| L-SETit.Pox-1:1:1 | 147 | Peroxidase 1 |
| L-SETit.Ppc-1:1:1 | 148 | Phosphoenolpyruvate carboxylase |
| L-SETit.Ppdk-1:1:2 | 149 | Pyruvate orthophosphate dikinase |
| L-SETit.Ppdk-1:1:4 | 150 | Pyruvate orthophosphate dikinase |
| L-SETit.Pro1-1:1:1 | 151 | Prolamin |
| L-SETit.Pro2-1:1:2 | 152 | Prolamin |
| L-SETit.Prx-1:1:1 | 153 | Peroxidase |
| L-SETit.Prx17-1:1:1 | 154 | Peroxidase-17 |
| L-SETit.Prx2-1:1:2 | 155 | Peroxidase-2 |
| L-SETit.Prx3-1:1:1 | 156 | Peroxidase-3 |
| L-SETit.Prx47-1:1:1 | 157 | Peroxidase-47 |
| L-SETit.Prx72-1:1:1 | 158 | Peroxidase-72 |
| L-SETit.PSI-4a-1:1:1 | 159 | Photosystem 1 4a |
| L-SETit.Rbcs-1:1:1 | 160 | Small subunit RUBISCO |
| L-SETit.Rcc3-1:1:1 | 161 | Lipid Transfer Protein-RCc3 |
| L-SETit.Rcc3-1:1:2 | 162 | Lipid Transfer Protein-RCc3 |
| L-SETit.Srp-1:1:1 | 163 | Stress responsive protein |
| L-SETit.Ssp1-1:1:1 | 164 | Seed storage protein |
| L-SETit.Tip-1:1:1 | 165 | Tonoplast intrinsic protein |
| L-SETit.TubA2-1-1:1:1 | 166 | Tubulin A2-1 |
| L-SETit.TubA2-2-1:1:1 | 167 | Tubulin A2-2 |
| L-SETit.TubA3-1:1:1 | 168 | Tubulin A3 |
| L-SETit.Ubq1-1:1:1 | 169 | Ubiquitin 1 |
| L-SETit.Ubq5-1:1:1 | 170 | Ubiquitin 5 |
| L-SETit.Ucc1-1:1:1 | 171 | Uclacyanin |
| I-SETit.Act8-1:1:2 | 172 | Actin 8 |
| I-SETit.CLUS120796-1-1:1:1 | 173 | Cluster 120796-1 |
| I-SETit.CLUS19108-1:1:1 | 174 | Cluster 19108 |
| I-SETit.Ppdk-1:1:1 | 175 | Pyruvate orthophosphate dikinase |
| I-SETit.TubA2_1-1:1:2 | 176 | Tubulin A2-1 |
| I-SETit.Ubq1-1:1:1 | 177 | Ubiquitin 1 |
| I-SETit.Ubq5-1:1:2 | 178 | Ubiquitin 5 |
| I-SETit.14-3-3A-2-1:1:1 | 179 | 14-3-3-like protein A |
| I-SETit.14-3-3A-3-1:1:2 | 180 | 14-3-3-like protein A |
| I-SETit.14-3-3A-4-1:1:2 | 181 | 14-3-3-like protein A |
| I-SETit.14-3-3A-5-1:1:2 | 182 | 14-3-3-like protein A |

TABLE 1-continued

Regulatory elements and corresponding promoters, leaders and introns; and transit (localization) sequences.

| Annotation | SEQ ID NO: | Description |
|---|---|---|
| I-SETit.14-3-3B-2-1:1:1 | 183 | 14-3-3-like protein B |
| I-SETit.14-3-3B-3-1:1:2 | 184 | 14-3-3-like protein B |
| I-SETit.14-3-3B-4-1:1:2 | 185 | 14-3-3-like protein B |
| I-SETit.14-3-3B-5-1:1:2 | 186 | 14-3-3-like protein B |
| I-SETit.14-3-3C-1-1:1:1 | 187 | 14-3-3-like protein C |
| I-SETit.14-3-3C-2-1:1:1 | 188 | 14-3-3-like protein C |
| I-SETit.14-3-3C-3-1:1:2 | 189 | 14-3-3-like protein C |
| I-SETit.14-3-3C-4-1:1:2 | 190 | 14-3-3-like protein C |
| I-SETit.14-3-3C-5-1:1:2 | 191 | 14-3-3-like protein C |
| I-SETit.14-3-3D-1-1:1:2 | 192 | 14-3-3-like protein D |
| I-SETit.14-3-3D-2-1:1:1 | 193 | 14-3-3-like protein D |
| I-SETit.14-3-3D-3-1:1:2 | 194 | 14-3-3-like protein D |
| I-SETit.14-3-3D-4-1:1:3 | 195 | 14-3-3-like protein D |
| I-SETit.14-3-3D-5-1:1:2 | 196 | 14-3-3-like protein D |
| I-SETit.14-3-3E-2-1:1:1 | 197 | 14-3-3-like protein E |
| I-SETit.14-3-3E-3-1:1:2 | 198 | 14-3-3-like protein E |
| I-SETit.14-3-3E-4-1:1:2 | 199 | 14-3-3-like protein E |
| I-SETit.14-3-3E-5-1:1:2 | 200 | 14-3-3-like protein E |
| I-SETit.40S-7S-1_1-1:1:2 | 201 | 40S ribosomal protein S7 |
| I-SETit.40S-7S-1_2-1:1:2 | 202 | 40S ribosomal protein S7 |
| I-SETit.40S-7S-1_3-1:1:2 | 203 | 40S ribosomal protein S7 |
| I-SETit.40S-7S-1_4-1:1:2 | 204 | 40S ribosomal protein S7 |
| I-SETit.40S-7S-2_2-1:1:1 | 205 | 40S ribosomal protein S7 |
| I-SETit.40S-7S-2_3-1:1:1 | 206 | 40S ribosomal protein S7 |
| I-SETit.40S-7S-2_4-1:1:1 | 207 | 40S ribosomal protein S7 |
| I-SETit.40S-7S-3_1-1:1:2 | 208 | 40S ribosomal protein S7 |
| I-SETit.40S-7S-3_2-1:1:2 | 209 | 40S ribosomal protein S7 |
| I-SETit.40S-7S-3_3-1:1:2 | 210 | 40S ribosomal protein S7 |
| I-SETit.60S_L10A1-1-1:1:2 | 211 | 60S ribosomal protein L10A1 |
| I-SETit.60S_L10A1-2-1:1:2 | 212 | 60S ribosomal protein L10A1 |
| I-SETit.60S_L10A1-3-1:1:2 | 213 | 60S ribosomal protein L10A1 |
| I-SETit.60S_L10A1-4-1:1:1 | 214 | 60S ribosomal protein L10A1 |
| I-SETit.60S_L10A1-5-1:1:2 | 215 | 60S ribosomal protein L10A1 |
| I-SETit.ASA2-3-1:1:2 | 216 | Anthranilate Synthase alpha 2 subunit |
| I-SETit.ClpD-1-1:1:1 | 217 | ATP-dependent Clp protease ATP-binding subunit |
| I-SETit.DnaJ_1-1:1:2 | 218 | Heat shock protein |
| I-SETit.DnaJ3-2-1:1:2 | 219 | Heat shock protein |
| I-SETit.eEF1g_1-1:1:2 | 220 | Elongation Factor 1 gamma |
| I-SETit.eEF1g_4-1:1:3 | 221 | Elongation Factor 1 gamma |
| I-SETit.eIF5A1-1-1:1:1 | 222 | Elongation Factor 5 alpha |
| I-SETit.eIF5A1-2-1:1:2 | 223 | Elongation Factor 5 alpha |
| I-SETit.eIF5A1-3-1:1:2 | 224 | Elongation Factor 5 alpha |
| I-SETit.eIF5A1-4-1:1:2 | 225 | Elongation Factor 5 alpha |
| I-SETit.eIF5A1-5-1:1:2 | 226 | Elongation Factor 5 alpha |
| I-SETit.eIF5A2-1-1:1:2 | 227 | Elongation Factor 5 alpha |
| I-SETit.eIF5A2-2-1:1:3 | 228 | Elongation Factor 5 alpha |
| I-SETit.eIF5A2-3-1:1:2 | 229 | Elongation Factor 5 alpha |
| I-SETit.eIF5A2-4-1:1:2 | 230 | Elongation Factor 5 alpha |
| I-SETit.eIF5A2-5-1:1:2 | 231 | Elongation Factor 5 alpha |
| I-SETit.eIF5A3-1-1:1:1 | 232 | Elongation Factor 5 alpha |
| I-SETit.eIF5A3-2-1:1:2 | 233 | Elongation Factor 5 alpha |
| I-SETit.eIF5A3-3-1:1:2 | 234 | Elongation Factor 5 alpha |
| I-SETit.eIF5A3-4-1:1:2 | 235 | Elongation Factor 5 alpha |
| I-SETit.eIF5A3-5-1:1:2 | 236 | Elongation Factor 5 alpha |
| I-SETit.GAD_1-1:1:2 | 237 | UDP-glucuronic acid decarboxylase |
| I-SETit.GAD_2-1:1:2 | 238 | UDP-glucuronic acid decarboxylase |
| I-SETit.GAD_3-1:1:2 | 239 | UDP-glucuronic acid decarboxylase |
| I-SETit.GAD_4-1:1:2 | 240 | UDP-glucuronic acid decarboxylase |
| I-SETit.Grf1-3-1:1:1 | 241 | Putative growth-regulating factor |
| I-SETit.GRP-1-1:1:1 | 242 | Glycine-rich RNA binding protein |
| I-SETit.LSm8-1-1:1:2 | 243 | U6 snRNA-associated Sm-like protein LSm8 |
| I-SETit.LSm8-2-1:1:1 | 244 | U6 snRNA-associated Sm-like protein LSm8 |
| I-SETit.LSm8-3-1:1:1 | 245 | U6 snRNA-associated Sm-like protein LSm8 |
| I-SETit.LSm8-4-1:1:2 | 246 | U6 snRNA-associated Sm-like protein LSm8 |
| I-SETit.PGK3_1-1:1:2 | 247 | Phosphoglycerate kinase |
| I-SETit.PGK3_2-1:1:1 | 248 | Phosphoglycerate kinase |
| I-SETit.PIP1_1_2-1:1:1 | 249 | Aquaporin |
| I-SETit.PIP1-1_1-1:1:1 | 250 | Aquaporin |
| I-SETit.PIP1-1_3-1:1:2 | 251 | Aquaporin |
| I-SETit.PIP1-4_3-1:1:2 | 252 | Aquaporin |
| I-SETit.PIP2-2_2-1:1:2 | 253 | Aquaporin |
| I-SETit.PIP2-2_3-1:1:2 | 254 | Aquaporin |
| I-SETit.PIP2-5_2-1:1:2 | 255 | Aquaporin |

TABLE 1-continued

Regulatory elements and corresponding promoters, leaders and introns; and transit (localization) sequences.

| Annotation | SEQ ID NO: | Description |
| --- | --- | --- |
| I-SETit.PIP2-5_3-1:1:2 | 256 | Aguaporin |
| I-SETit.Prx17-2-1:1:1 | 257 | Peroxidase 17 |
| I-SETit.Prx3-1-1:1:2 | 258 | Peroxidase 3 |
| I-SETit.SBD-1-1:1:2 | 259 | Shwachman-Bodian-Diamond syndrome protein |
| I-SETit.SBD-2-1:1:1 | 260 | Shwachman-Bodian-Diamond syndrome protein |
| I-SETit.SBD-3-1:1:2 | 261 | Shwachman-Bodian-Diamond syndrome protein |
| I-SETit.TubA2_1-1:1:1 | 262 | Tubulin A2 |
| I-SETit.TubA2_2-1:1:1 | 263 | Tubulin A2 |
| I-SETit.TubA2_3-1:1:1 | 264 | Tubulin A2 |
| I-SETit.TubA3_1-1:1:1 | 265 | Tubulin A3 |
| I-SETit.TubA3_2-1:1:1 | 266 | Tubulin A3 |
| I-SETit.Wx1-1-1:1:2 | 267 | Putative granule bound starch synthase |
| T-SETit.Act1-1:1:1 | 268 | Actin 1 |
| T-SETit.Act8-1:1:1 | 269 | Actin 8 |
| T-SETit.Ams1-1:1:1 | 270 | S-adenosylmethionine synthetase 1 |
| T-SETit.Ctpt-1:1:2 | 271 | Triose phosphate/phosphate translocator, chloroplast precursor |
| T-SETit.Fba-1:1:1 | 272 | Fructose-bisphosphate aldolase |
| T-SETit.Fnr-1:1:1 | 273 | Ferredoxin-NADP+ reductase |
| T-SETit.Mes2-1:1:1 | 274 | Methionine synthase 2 |
| T-SETit.Ntr-1:1:1 | 275 | Nitrite transporter |
| T-SETit.Sus2-1:1:1 | 276 | Sucrose synthase 2 |
| GOI-TS-APX | 277 | Ascorbate Peroxidase |
| GOI-TS-APX:1:2 | 278 | Ascorbate Peroxidase |
| GOI-TS-APX2:1:1 | 279 | Ascorbate Peroxidase |
| GOI-TS-CNT:1:2 | 280 | 2-C-methyl-D-erythritol 4-phosphate cytidylyltransferase |
| GOI-TS-DHDPS:1:2 | 281 | Dihydrodipicolinate synthase precursor, chloroplastic |
| GOI-TS-Fe-SD:1:1 | 282 | Iron-superoxidedismutases, chloroplastic |
| GOI-TS-PPR:1:1 | 283 | Pentatricopeptide repeat-containing protein, putative |
| TS-SETit.APG6-1:1:1 | 284 | Casein lytic proteinase B3 heat shock protein-like |
| TS-SETit.APX.2.ex1-1:1:1 | 285 | Ascorbate Peroxidase |
| TS-SETit.APX.ex1-1:1:1 | 286 | Ascorbate Peroxidase |
| TS-SETit.APX.ex2-1:1:2 | 287 | Ascorbate Peroxidase |
| TS-SETit.APX2.ex2-1:1:1 | 288 | Ascorbate Peroxidase |
| TS-SETit.APX3-1:1:1 | 289 | Ascorbate Peroxidase |
| TS-SETit.ASA2-1:1:1 | 290 | Anthranilate Synthase alpha 2 subunit |
| TS-SETit.CC10-1:1:1 | 291 | Chloroplast Chaperonin 10 Kd subunit |
| TS-SETit.CHoR1-1:1:1 | 292 | Calcium homeostasis regulator |
| TS-SETit.ClpD-1:1:1 | 293 | ATP-dependent Clp protease ATP-binding subunit |
| TS-SETit.CNT.ex1-1:1:1 | 294 | 2-C-methyl-D-erythritol 4-phosphate cytidylyltransferase |
| TS-SETit.CNT.ex2-1:1:2 | 295 | 2-C-methyl-D-erythritol 4-phosphate cytidylyltransferase |
| TS-SETit.CR88-1:1:1 | 296 | Heat-shock protein putative |
| TS-SETit.DHDPS.Ex1-1:1:1 | 297 | Dihydrodipicolinate synthase precursor, chloroplastic |
| TS-SETit.DHDPS.Ex2-1:1:1 | 298 | Dihydrodipicolinate synthase precursor, chloroplastic |
| TS-SETit.Fe-SD.ex1-1:1:1 | 299 | Iron-superoxidedismutases, chloroplastic |
| TS-SETit.Fe-SD.ex2-1:1:1 | 300 | Iron-superoxidedismutases, chloroplastic |
| TS-SETit.G-typA-1:1:1 | 301 | GTP-binding protein typA |
| TS-SETit.HDh-1:1:1 | 302 | Haloacid dehalogenase-like hydrolase |
| TS-SETit.IMP-1:1:1 | 303 | Inositol-1-monophosphatase, putative, chloroplastic |
| TS-SETit.MDH-1:1:1 | 304 | Putative NAD-malate dehydrogenase |
| TS-SETit.PPR.ex1-1:1:1 | 305 | Pentatricopeptide repeat-containing protein, putative |
| TS-SETit.PPR.ex2-1:1:2 | 306 | Pentatricopeptide repeat-containing protein, putative |
| TS-SETit.PSPR-3-1:1:1 | 307 | Plastid-specific 30S ribosomal protein 3 |
| TS-SETit.RbcS_1-1:1:1 | 308 | Small subunit RUBISCO |
| TS-SETit.RbcS_2-1:1:1 | 309 | Small subunit RUBISCO |
| TS-SETit.RbcS_3-1:1:1 | 310 | Small subunit RUBISCO |
| TS-SETit.RbcS_4-1:1:1 | 311 | Small subunit RUBISCO |
| TS-SETit.ShkG-1:1:1 | 312 | 5-enolpyruvylshikimate-3-phosphate synthase precursor |

TABLE 1-continued

Regulatory elements and corresponding promoters, leaders and introns; and transit (localization) sequences.

| Annotation | SEQ ID NO: | Description |
|---|---|---|
| TS-SETit.SRP43-1:1:1 | 313 | Signal recognition particle 43 kDa protein, chloroplastic |
| TS-SETit.TDh-1:1:1 | 314 | Threonine dehydratase biosynthetic, chloroplast precursor |
| TS-SETit.ThR-1:1:1 | 315 | Thioredoxin |
| TS-SETit.Wx1-1:1:1 | 316 | Putative granule bound starch synthase |
| I-SETit.APX.2-1:1:1 | 317 | Ascorbate Peroxidase |
| I-SETit.APX-1:1:1 | 318 | Ascorbate Peroxidase |
| I-SETit.APX-1:1:2 | 319 | Ascorbate Peroxidase |
| I-SETit.CNT.1-1:1:1 | 320 | 2-C-methyl-D-erythritol 4-phosphate cytidylyltransferase |
| I-SETit.DHDPS__1-1:1:1 | 321 | Dihydrodipicolinate synthase precursor, chloroplastic |
| I-SETit.Fe-SD-1:1:1 | 322 | Iron-superoxidedismutases, chloroplastic |
| I-SETit.PPR-1:1:2 | 323 | Pentatricopeptide repeat-containing protein, putative |
| TS-SETit.APG6.pep | 324 | Casein lytic proteinase B3 heat shock protein-like |
| TS-SETit.APX.2.pep | 325 | Ascorbate Peroxidase |
| TS-SETit.APX.pep | 326 | Ascorbate Peroxidase |
| TS-SETit.APX3.pep | 327 | Ascorbate Peroxidase |
| TS-SETit.ASA2.pep | 328 | Anthranilate Synthase alpha 2 subunit |
| TS-SETit.CC10.pep | 329 | Chloroplast Chaperonin 10 Kd subunit |
| TS-SETit.CHoR1.pep | 330 | Calcium homeostasis regulator |
| TS-SETit.ClpD.pep | 331 | ATP-dependent Clp protease ATP-binding subunit |
| TS-SETit.CNT.pep | 332 | 2-C-methyl-D-erythritol 4-phosphate cytidylyltransferase |
| TS-SETit.CR88.pep | 333 | Heat-shock protein putative |
| TS-SETit.DHDPS.pep | 334 | Dihydrodipicolinate synthase precursor, chloroplastic |
| TS-SETit.Fe-SD.pep | 335 | Iron-superoxidedismutases, chloroplastic |
| TS-SETit.G-typA.pep | 336 | GTP-binding protein typA |
| TS-SETit.HDh.pep | 337 | Haloacid dehalogenase-like hydrolase |
| TS-SETit.IMP.pep | 338 | Inositol-1-monophosphatase, putative, chloroplastic |
| TS-SETit.MDH.pep | 339 | Putative NAD-malate dehydrogenase |
| TS-SETit.PPR.pep | 340 | Pentatricopeptide repeat-containing protein, putative |
| TS-SETit.PSPR-3.pep | 341 | Plastid-specific 30S ribosomal protein 3 |
| TS-SETit.RbcS__1.pep | 342 | Small subunit RUBISCO |
| TS-SETit.RbcS__2.pep | 343 | Small subunit RUBISCO |
| TS-SETit.RbcS__3.pep | 344 | Small subunit RUBISCO |
| TS-SETit.RbcS__4.pep | 345 | Small subunit RUBISCO |
| TS-SETit.ShkG.pep | 346 | 5-enolpyruvylshikimate-3-phosphate synthase precursor |
| TS-SETit.SRP43.pep | 347 | Signal recognition particle 43 kDa protein, chloroplastic |
| TS-SETit.TDh.pep | 348 | Threonine dehydratase biosynthetic, chloroplast precursor |
| TS-SETit.ThR.pep | 349 | Thioredoxin |
| TS-SETit.Wx1.pep | 350 | Putative granule bound starch synthase |
| E-FMV.35S-1:1:2 | 351 | FMV 35S enhancer |
| E-SETit.Mth-1:1:2 | 352 | Metallothionein |
| P-SETit.25509-1:1:1 | 353 | Cluster 25509 |
| P-SETit.25509-1:1:2 | 354 | Cluster 25509 |
| P-SETit.Act8-1:1:1 | 355 | Actin 8 |
| P-SETit.Act8-1:1:2 | 356 | Actin 8 |
| P-SETit.Act8-1:1:3 | 357 | Actin 8 |
| P-SETit.Act8-1:1:4 | 358 | Actin 8 |
| P-SETit.Act8-1:1:7 | 359 | Actin 8 |
| P-SETit.Act8-1-1:1:1 | 360 | Actin 8 |
| P-SETit.Aip-1:1:2 | 361 | Auxin-induced protein |
| P-SETit.AKR-1:1:1 | 362 | Aspartate kinase reductase |
| P-SETit.AKR-1:1:2 | 363 | Aspartate kinase reductase |
| P-SETit.Alc2-1:1:1 | 364 | Alpha-coixin |
| P-SETit.Ali1-1:1:1 | 365 | Aluminum-induced protein |
| P-SETit.Ali1-1:1:2 | 366 | Aluminum-induced protein |
| P-SETit.Ali1-1:1:4 | 367 | Aluminum-induced protein |
| P-SETit.Cab3-1:1:1 | 368 | Chlorophyll a/b binding protein 3 |
| P-SETit.Cab3-1:1:2 | 369 | Chlorophyll a/b binding protein 3 |
| P-SETit.cab6-1:1:1 | 370 | Chlorophyll a/b binding protein 6 |
| P-SETit.Cab6-1:1:1 | 371 | Chlorophyll a/b binding protein 6 |
| P-SETit.Cab6-1:1:2 | 372 | Chlorophyll a/b binding protein 6 |

TABLE 1-continued

Regulatory elements and corresponding promoters, leaders and introns; and transit (localization) sequences.

| Annotation | SEQ ID NO: | Description |
|---|---|---|
| P-SETit.Cafeoyl CoA methyltransferase-1:1:1 | 373 | Cafeoyl CoA methyltransferase |
| P-SETit.Caffeoyl-CoA O-methyltrasnferase-1:1:1 | 374 | Cafeoyl CoA methyltransferase |
| P-SETit.Caffeoyl-CoA O-methyltrasnferase-a-1:1:1 | 375 | Cafeoyl CoA methyltransferase |
| P-SETit.Ccoamt-1:1:1 | 376 | Cafeoyl CoA methyltransferase |
| P-SETit.Chi-1:1:1 | 377 | Chitinase |
| P-SETit.chitinase-1:1:1 | 378 | Chitinase |
| P-SETit.Chitinase-1:1:1 | 379 | Chitinase |
| P-SETit.Chitinase-1:1:2 | 380 | Chitinase |
| P-SETit.Chitinase-1:1:3 | 381 | Chitinase |
| P-SETit.Chl A/b III-1:1:1 | 382 | Chlorophyll a/b binding protein 3 |
| P-SETit.Chl a/b pre-1:1:1 | 383 | Chlorophyll a/b binding pre-protein |
| P-SETit.Class III citinase-1:1:1 | 384 | Class III citinase |
| P-SETit.Class III citinase-1:1:2 | 385 | Class III citinase |
| P-SETit.Class III citinase-1:1:3 | 386 | Class III citinase |
| P-SETit.CLUS19108-1:1:1 | 387 | Cluster 19108 |
| P-SETit.CLUS882664-1-1:1:1 | 388 | Cluster 882664 |
| P-SETit.CLUS882664-1-1:1:2 | 389 | Cluster 882664 |
| P-SETit.Cp26-1:1:1 | 390 | Chloroplast protein-26 |
| P-SETit.Cp26-1:1:2 | 391 | Chloroplast protein-26 |
| P-SETit.CP29-1:1:1 | 392 | Chloroplast protein-29 |
| P-SETit.CP29-1:1:2 | 393 | Chloroplast protein-29 |
| P-SETit.CP29-1:1:3 | 394 | Chloroplast protein-29 |
| P-SETit.CP29-1:1:5 | 395 | Chloroplast protein-29 |
| P-SETit.Cyp78a-1:1:1 | 396 | Cysteine protease-78a |
| P-SETit.Cys-1:1:1 | 397 | Cystein protease |
| P-SETit.Cys-1:1:4 | 398 | Cystein protease |
| P-SETit.Cys-1:1:5 | 399 | Cystein protease |
| P-SETit.DRP-1:1:1 | 400 | Dehydration responsive protein |
| P-SETit.DRP-1:1:2 | 401 | Dehydration responsive protein |
| P-SETit.DRP-B-1:1:1 | 402 | Dehydration responsive protein |
| P-SETit.Dzs-1:1:1 | 403 | Delta zein storage protein |
| P-SETit.Dzs-1:1:2 | 404 | Delta zein storage protein |
| P-SETit.Dzs-1:1:3 | 405 | Delta zein storage protein |
| P-SETit.ESTCLUS675389-2-1:1:1 | 406 | Cluster 675389-2 |
| P-SETit.ESTCLUS675389-2-1:1:2 | 407 | Cluster 675389-2 |
| P-SETit.FBP-ald-1:1:1 | 408 | Fructose 1,6-Bisphosphate Aldolase |
| P-SETit.FM54-1:1:1 | 409 | Cluster 1102871_1 |
| P-SETit.FM63-1:1:1 | 410 | Cluster 1019870_1 |
| P-SETit.foxtailRcc3-1:1:1 | 411 | Lipid Transfer Protein-RCc3 |
| P-SETit.FStr1-1:1:1 | 412 | Flavonol 4-sulfotransferase |
| P-SETit.FStr1-1:1:2 | 413 | Flavonol 4-sulfotransferase |
| P-SETit.FStr2-1:1:1 | 414 | Flavonol 4-sulfotransferase |
| P-SETit.Gahdp-1:1:1 | 415 | Glyceraldehyde-3-phosphate dehydrogenase |
| P-SETit.Gahdp-1:1:2 | 416 | Glyceraldehyde-3-phosphate dehydrogenase |
| P-SETit.gapdh-1:1:1 | 417 | Glyceraldehyde-3-phosphate dehydrogenase |
| P-SETit.Gapdh2-1:1:1 | 418 | Glyceraldehyde-3-phosphate dehydrogenase |
| P-SETit.Gapdh2-1:1:2 | 419 | Glyceraldehyde-3-phosphate dehydrogenase |
| P-SETit.Glutathione S-Transferase-1:1:1 | 420 | Glutathione S-Transferase |
| P-SETit.Glutathione S-transferase-1:1:1 | 421 | Glutathione S-Transferase |
| P-SETit.Glutathione S-transferase-1:1:2 | 422 | Glutathione S-Transferase |
| P-SETit.GlutathioneS-transferase-1:1:3 | 423 | Glutathione S-Transferase |
| P-SETit.Grcw2-1:1:2 | 424 | Glycine-rich cell wall structural protein 2 |
| P-SETit.Grf-1:1:1 | 425 | Putative growth-regulating factor |
| P-SETit.Ifr-1:1:1 | 426 | Isoflavone Reducatase |
| P-SETit.Ifr2-1:1:1 | 427 | Isoflavone Reducatase |
| P-SETit.Isoflavone Red Like-1:1:1 | 428 | Isoflavone Reductase like |
| P-SETit.Isoflavone Reducatase like-1:1:2 | 429 | Isoflavone Reductase like |
| P-SETit.Isoflavone Reductase 2-1:1:1 | 430 | Isoflavone Reductase |
| P-SETit.Isoflavone Reductase Like-1:1:1 | 431 | Isoflavone Reductase like |
| P-SETit.Isoflavone Reductase-1:1:1 | 432 | Isoflavone Reductase |

TABLE 1-continued

Regulatory elements and corresponding promoters, leaders and introns; and transit (localization) sequences.

| Annotation | SEQ ID NO: | Description |
| --- | --- | --- |
| P-SETit.Isoflavone reductase-1:1:1 | 433 | Isoflavone Reductase |
| P-SETit.Isoflavone reductase-1:1:2 | 434 | Isoflavone Reductase |
| P-SETit.IsoflavoneReductase1-1:1:1 | 435 | Isoflavone Reductase |
| P-SETit.IsoflavoneReductase1-1:1:2 | 436 | Isoflavone Reductase |
| P-SETit.LaDo-1:1:1 | 437 | leucoanthocianidin dioxygenase |
| P-SETit.Mt1-1:1:1 | 438 | Metallothionein-like protein 1 |
| P-SETit.Mt1-1:1:3 | 439 | Metallothionein-like protein 1 |
| P-SETit.Mth-1:1:1 | 440 | Metallothionein |
| P-SETit.Mth-1:1:2 | 441 | Metallothionein |
| P-SETit.Mth-1:1:4 | 442 | Metallothionein |
| P-SETit.MTLP-1:1:1 | 443 | Metallothionein-like protein |
| P-SETit.MTLP-1:1:2 | 444 | Metallothionein-like protein |
| P-SETit.MTLP-1:1:3 | 445 | Metallothionein-like protein |
| P-SETit.Nadp-Me-1:1:1 | 446 | NADP malate enzyme |
| P-SETit.Nadp-me-1:1:1 | 447 | NADP malate enzyme |
| P-SETit.Nitrite Transporter-1:1:1 | 448 | Nitrite transporter |
| P-SETit.Nitrite transporter-1:1:1 | 449 | Nitrite transporter |
| P-SETit.Nitrite Transporter-1:1:2 | 450 | Nitrite transporter |
| P-SETit.Nitrite transporter-1:1:2 | 451 | Nitrite transporter |
| P-SETit.Nitrite Transporter-1:1:3 | 452 | Nitrite transporter |
| P-SETit.Nitritetransporter-1:1:3 | 453 | Nitrite transporter |
| P-SETit.Nr1-1:1:1 | 454 | Nitrate reductase |
| P-SETit.Nr1-1:1:2 | 455 | Nitrate reductase |
| P-SETit.Nr1-1:1:3 | 456 | Nitrate reductase |
| P-SETit.Nr1-1:1:4 | 457 | Nitrate reductase |
| P-SETit.Nr1-1:1:5 | 458 | Nitrate reductase |
| P-SETit.NRED-1:1:1 | 459 | Nitrate reductase |
| P-SETit.Nrt2-1:1:1 | 460 | Nitrate transporter-like protein |
| P-SETit.OMT2.1-1:1:1 | 461 | O-methyltransferase |
| P-SETit.OMT2.2-1:1:1 | 462 | O-methyltransferase |
| P-SETit.Omt3-1:1:1 | 463 | O-methyltransferase |
| P-SETit.Omt3-1:1:2 | 464 | O-methyltransferase |
| P-SETit.Omt4_2-1:1:1 | 465 | O-methyltransferase |
| P-SETit.OMt4-1:1:1 | 466 | O-methyltransferase |
| P-SETit.Peroxidase-1:1:1 | 467 | Peroxidase |
| P-SETit.Peroxidase-1:1:2 | 468 | Peroxidase |
| P-SETit.Pip2-1:1:1 | 469 | Aquaporin |
| P-SETit.pip2-1:1:1 | 470 | Aquaporin |
| P-SETit.Pip2-1:1:2 | 471 | Aquaporin |
| P-SETit.pip2-1:1:2 | 472 | Aquaporin |
| P-SETit.Pip2-3-1:1:2 | 473 | Aquaporin |
| P-SETit.Pip2-3-1:1:3 | 474 | Aquaporin |
| P-SETit.Pip2-3-1:1:4 | 475 | Aquaporin |
| P-SETit.PIP2-5-1:1:1 | 476 | Aquaporin |
| P-SETit.POX-1:1:1 | 477 | Peroxidase |
| P-SETit.Ppc-1:1:1 | 478 | Phosphoenolpyruvate carboxylase |
| P-SETit.Ppc-1:1:2 | 479 | Phosphoenolpyruvate carboxylase |
| P-SETit.Ppc-1:1:5 | 480 | Phosphoenolpyruvate carboxylase |
| P-SETit.Ppc-1:1:6 | 481 | Phosphoenolpyruvate carboxylase |
| P-SETit.Ppdk-1:1:2 | 482 | Pyruvate orthophosphate dikinase |
| P-SETit.Pro1-1:1:1 | 483 | Prolamine 1 |
| P-SETit.Pro2-1:1:1 | 484 | Prolamine 2 |
| P-SETit.Pro2-1:1:2 | 485 | Prolamine 2 |
| P-SETit.Prx17-1:1:1 | 486 | Peroxidase 17 |
| P-SETit.Prx2-1:1:1 | 487 | Peroxidase 2 |
| P-SETit.Prx2-1:1:2 | 488 | Peroxidase 2 |
| P-SETit.Prx2-1:1:4 | 489 | Peroxidase 2 |
| P-SETit.Prx3-1:1:1 | 490 | Peroxidase 3 |
| P-SETit.Prx3-1:1:2 | 491 | Peroxidase 3 |
| P-SETit.Prx3-1:1:5 | 492 | Peroxidase 3 |
| P-SETit.Prx4-1:1:1 | 493 | Peroxidase 4 |
| P-SETit.Prx47-1:1:1 | 494 | Peroxidase 47 |
| P-SETit.Prx47-1:1:3 | 495 | Peroxidase 47 |
| P-SETit.Prx72-1:1:1 | 496 | Peroxidase 72 |
| P-SETit.PSIRC-1:1:1 | 497 | Photosystem 1 reaction center |

TABLE 1-continued

Regulatory elements and corresponding promoters, leaders and introns; and transit (localization) sequences.

| Annotation | SEQ ID NO: | Description |
|---|---|---|
| P-SETit.Rbcs-1:1:2 | 498 | Small subunit RUBISCO |
| P-SETit.Rcc3-1:1:12 | 499 | Lipid Transfer Protein-RCc3 |
| P-SETit.Rcc3-1:1:13 | 500 | Lipid Transfer Protein-RCc3 |
| P-SETit.Rcc3-1:1:14 | 501 | Lipid Transfer Protein-RCc3 |
| P-SETit.Rcc3-1:1:15 | 502 | Lipid Transfer Protein-RCc3 |
| P-SETit.Rcc3-1:1:2 | 503 | Lipid Transfer Protein-RCc3 |
| P-SETit.Rcc3-1:1:3 | 504 | Lipid Transfer Protein-RCc3 |
| P-SETit.Rcc3-1:1:4 | 505 | Lipid Transfer Protein-RCc3 |
| P-SETit.Rcc3-1:1:5 | 506 | Lipid Transfer Protein-RCc3 |
| P-SETit.Rcc3-1:1:6 | 507 | Lipid Transfer Protein-RCc3 |
| P-SETit.Rcc3-1:1:7 | 508 | Lipid Transfer Protein-RCc3 |
| P-SETit.Rcc3-1:1:8 | 509 | Lipid Transfer Protein-RCc3 |
| P-SETit.Rcc3-1:1:9 | 510 | Lipid Transfer Protein-RCc3 |
| P-SETit.RUBP-1:1:1 | 511 | RuBP-carboxylase/oxygenase |
| P-SETit.RUBP-pre-1:1:1 | 512 | RuBP-carboxylase/oxygenase precursor |
| P-SETit.Srp-1:1:1 | 513 | Stress responsive protein |
| P-SETit.Srp-1:1:3 | 514 | Stress responsive protein |
| P-SETit.Tga6-1:1:1 | 515 | Teosinte glume architecture |
| P-SETit.TGA6-1:1:1 | 516 | Teosinte glume architecture |
| P-SETit.TGA6-1:1:2 | 517 | Teosinte glume architecture |
| P-SETit.TIP-1:1:1 | 518 | Tonoplast intrinsic protein |
| P-SETit.Tip-1:1:2 | 519 | Tonoplast intrinsic protein |
| P-SETit.Tip-1:1:3 | 520 | Tonoplast intrinsic protein |
| P-SETit.Tip-1:1:5 | 521 | Tonoplast intrinsic protein |
| P-SETit.Tip-1:1:6 | 522 | Tonoplast intrinsic protein |
| P-SETit.Tub3A-1:1:1 | 523 | Tubulin A3 |
| P-SETit.TubA-1:1:1 | 524 | Tubulin A |
| P-SETit.TubA-1:1:2 | 525 | Tubulin A |
| P-SETit.TubA2-1-1:1:1 | 526 | Tubulin A2 |
| P-SETit.TubA2-1-1:1:4 | 527 | Tubulin A2 |
| P-SETit.TubA2-2-1:1:1 | 528 | Tubulin A2 |
| P-SETit.TubA2-2-1:1:2 | 529 | Tubulin A2 |
| P-SETit.TubA3-1:1:1 | 530 | Tubulin A3 |
| P-SETit.TubA3-1:1:2 | 531 | Tubulin A3 |
| P-SETit.Ubq1-1:1:2 | 532 | Ubiquitin 1 |
| P-SETit.Ubq5-1:1:1 | 533 | Ubiquitin 5 |
| P-SETit.Ucc1-1:1:1 | 534 | Uclacyanin |
| P-SETit.Ucc1-1:1:3 | 535 | Uclacyanin |
| P-SETit.Ucc2-1:1:1 | 536 | Uclacyanin |
| L-SETit.25509-1:1:1 | 537 | Cluster 25509 |
| L-SETit.Act1-1:1:1 | 538 | Actin 1 |
| L-SETit.Act2-1:1:1 | 539 | Actin 2 |
| L-SETit.Act8-1:1:1 | 540 | Actin 8 |
| L-SETit.Actin-1:1:1 | 541 | Actin |
| L-SETit.AKR-1:1:1 | 542 | Aspartate kinase reductase |
| L-SETit.Cab3-1:1:2 | 543 | Chlorophyll a/b |
| L-SETit.Caffeoyl-CoA O-methyltrasnferase-1:1:1 | 544 | Caffeoyl-CoA O-methyltrasnferase |
| L-SETit.Caffeoyl-CoAO-methyltrasnferase-1:1:2 | 545 | Caffeoyl-CoA O-methyltrasnferase |
| L-SETit.Ccoamt-1:1:1 | 546 | Caffeoyl-CoA O-methyltrasnferase |
| L-SETit.Chi-1:1:1 | 547 | Chitinase |
| L-SETit.CP29-1:1:2 | 548 | Chloroplast protein-29 |
| L-SETit.CP29-1:1:3 | 549 | Chloroplast protein-29 |
| L-SETit.DRP-1:1:1 | 550 | Dehydration responsive protein |
| L-SETit.DRP-1:1:2 | 551 | Dehydration responsive protein |
| L-SETit.FStr1-1:1:1 | 552 | Flavonol 4-sulfotransferase |
| L-SETit.FStr1-1:1:2 | 553 | Flavonol 4-sulfotransferase |
| L-SETit.FStr1-1:1:3 | 554 | Flavonol 4-sulfotransferase |
| L-SETit.gapdh-1:1:1 | 555 | Glyceraldehyde-3-phosphate dehydrogenase |
| L-SETit.Gapdh-1:1:1 | 556 | Glyceraldehyde-3-phosphate dehydrogenase |
| L-SETit.Grf-1:1:1 | 557 | Putative growth-regulating factor |
| L-SETit.Grf-1:1:2 | 558 | Putative growth-regulating factor |
| L-SETit.Isoflavone Reductase 2-1:1:1 | 559 | Isoflavone Reductase |
| L-SETit.Isoflavone Reductase1-1:1:1 | 560 | Isoflavone Reductase |
| L-SETit.MOt4-1:1:1 | 561 | O-methyltransferase |
| L-SETit.Mth-1:1:1 | 562 | Metallothionein |
| L-SETit.Mth-1:1:2 | 563 | Metallothionein |
| L-SETit.MTLP-1:1:1 | 564 | Metallothionein like protein |
| L-SETit.MTLP-1:1:2 | 565 | Metallothionein like protein |
| L-SETit.Nadp-me-1:1:1 | 566 | NADP malate enzyme |
| L-SETit.NADP-Me-1:1:1 | 567 | NADP malate enzyme |

TABLE 1-continued

Regulatory elements and corresponding promoters, leaders and introns; and transit (localization) sequences.

| Annotation | SEQ ID NO: | Description |
| --- | --- | --- |
| L-SETit.Nr1-1:1:1 | 568 | Nitrate reductase |
| L-SETit.Nr1-1:1:2 | 569 | Nitrate reductase |
| L-SETit.Nr1-1:1:3 | 570 | Nitrate reductase |
| L-SETit.Nrt2-1:1:1 | 571 | Nitrate reductase |
| L-SETit.OMt4-1:1:1 | 572 | O-methyltransferase |
| L-SETit.Pip2-3-1:1:2 | 573 | Aquaporin |
| L-SETit.POX-1:1:1 | 574 | Peroxidase |
| L-SETit.Ppc-1:1:2 | 575 | Phosphoenolpyruvate carboxylase |
| L-SETit.Ppc-1:1:3 | 576 | Phosphoenolpyruvate carboxylase |
| L-SETit.Ppc-1:1:4 | 577 | Phosphoenolpyruvate carboxylase |
| L-SETit.Ppdk-1:1:1 | 578 | Pyruvate orthophosphate dikinase |
| L-SETit.Ppdk-1:1:3 | 579 | Pyruvate orthophosphate dikinase |
| L-SETit.Pro2-1:1:1 | 580 | Prolamine 2 |
| L-SETit.Prx2-1:1:1 | 581 | Peroxidase 2 |
| L-SETit.Prx4-1:1:1 | 582 | Peroxidase 4 |
| L-SETit.Rcc3-1:1:3 | 583 | Lipid Transfer Protein-RCc3 |
| L-SETit.TGA6-1:1:1 | 584 | Teosinte glume architecture |
| L-SETit.TIP-1:1:1 | 585 | Tonoplast intrinsic protein |
| L-SETit.Tip-1:1:2 | 586 | Tonoplast intrinsic protein |
| L-SETit.TubA-1:1:1 | 587 | Tubulin A |
| L-SETit.TubA-1:1:2 | 588 | Tubulin A |
| I-SETit.14-3-3A-3-1:1:1 | 589 | 14-3-3-like protein A |
| I-SETit.14-3-3A-4-1:1:1 | 590 | 14-3-3-like protein A |
| I-SETit.14-3-3A-5-1:1:1 | 591 | 14-3-3-like protein A |
| I-SETit.14-3-3B-3-1:1:1 | 592 | 14-3-3-like protein B |
| I-SETit.14-3-3B-4-1:1:1 | 593 | 14-3-3-like protein B |
| I-SETit.14-3-3B-5-1:1:1 | 594 | 14-3-3-like protein B |
| I-SETit.14-3-3C-3-1:1:1 | 595 | 14-3-3-like protein C |
| I-SETit.14-3-3C-4-1:1:1 | 596 | 14-3-3-like protein C |
| I-SETit.14-3-3C-5-1:1:1 | 597 | 14-3-3-like protein C |
| I-SETit.14-3-3D-1-1:1:1 | 598 | 14-3-3-like protein D |
| I-SETit.14-3-3D-3-1:1:1 | 599 | 14-3-3-like protein D |
| I-SETit.14-3-3D-4-1:1:1 | 600 | 14-3-3-like protein D |
| I-SETit.14-3-3D-4-1:1:2 | 601 | 14-3-3-like protein D |
| I-SETit.14-3-3D-5-1:1:1 | 602 | 14-3-3-like protein D |
| I-SETit.14-3-3E-3-1:1:1 | 603 | 14-3-3-like protein E |
| I-SETit.14-3-3E-4-1:1:1 | 604 | 14-3-3-like protein E |
| I-SETit.14-3-3E-5-1:1:1 | 605 | 14-3-3-like protein E |
| I-SETit.14-3-3lp-1:1:1 | 606 | 14-3-3-like protein |
| I-SETit.40S-7S-1_1-1:1:1 | 607 | 40S ribosomal protein S7 |
| I-SETit.40S-7S-1_2-1:1:1 | 608 | 40S ribosomal protein S7 |
| I-SETit.40S-7S-1_3-1:1:1 | 609 | 40S ribosomal protein S7 |
| I-SETit.40S-7S-1_4-1:1:1 | 610 | 40S ribosomal protein S7 |
| I-SETit.40S-7S-3_1-1:1:1 | 611 | 40S ribosomal protein S7 |
| I-SETit.40S-7S-3_2-1:1:1 | 612 | 40S ribosomal protein S7 |
| I-SETit.40S-7S-3_3-1:1:1 | 613 | 40S ribosomal protein S7 |
| I-SETit.40S-7S-3_3p-1:1:1 | 614 | 40S ribosomal protein S7 |
| I-SETit.60S_L10A1-1-1:1:1 | 615 | 60S ribosomal protein L10A1 |
| I-SETit.60S_L10A1-2-1:1:1 | 616 | 60S ribosomal protein L10A1 |
| I-SETit.60S_L10A1-3-1:1:1 | 617 | 60S ribosomal protein L10A1 |
| I-SETit.60S_L10A1-5-1:1:1 | 618 | 60S ribosomal protein L10A1 |
| I-SETit.Act1-1:1:1 | 619 | Actin 1 |
| I-SETit.Act1-1:1:2 | 620 | Actin 1 |
| I-SETit.Act1-1:1:3 | 621 | Actin 1 |
| I-SETit.Act1-1:1:4 | 622 | Actin 1 |
| I-SETit.Act2-1:1:1 | 623 | Actin 2 |
| I-SETit.Act3-1:1:1 | 624 | Actin 3 |
| I-SETit.Act3-1:1:2 | 625 | Actin 3 |
| I-SETit.Act4-1:1:1 | 626 | Actin 4 |
| I-SETit.Act4-1:1:2 | 627 | Actin 4 |
| I-SETit.Act6-1:1:1 | 628 | Actin 6 |
| I-SETit.Act6-1:1:2 | 629 | Actin 6 |
| I-SETit.Act6-1:1:3 | 630 | Actin 6 |
| I-SETit.Act6-1:1:4 | 631 | Actin 6 |
| I-SETit.Act7-1:1:1 | 632 | Actin 7 |
| I-SETit.Act7-1:1:2 | 633 | Actin 7 |
| I-SETit.Act7-1:1:3 | 634 | Actin 7 |
| I-SETit.Act8-1:1:1 | 635 | Actin 8 |
| I-SETit.Actin1-1:1:1 | 636 | Actin 1 |
| I-SETit.Arp1_1-1:1:1 | 637 | 60S acidic ribosomal protein P2A, putative, expressed |
| I-SETit.Arp1_1-1:1:2 | 638 | 60S acidic ribosomal protein P2A, putative, expressed |

TABLE 1-continued

Regulatory elements and corresponding promoters, leaders and introns; and transit (localization) sequences.

| Annotation | SEQ ID NO: | Description |
|---|---|---|
| I-SETit.Arp1_1-1:1:3 | 639 | 60S acidic ribosomal protein P2A, putative, expressed |
| I-SETit.Arp1_2-1:1:1 | 640 | 60S acidic ribosomal protein P2A, putative, expressed |
| I-SETit.Arp1_2-1:1:2 | 641 | 60S acidic ribosomal protein P2A, putative, expressed |
| I-SETit.Arp1_3-1:1:1 | 642 | 60S acidic ribosomal protein P2A, putative, expressed |
| I-SETit.Arp1_3-1:1:2 | 643 | 60S acidic ribosomal protein P2A, putative, expressed |
| I-SETit.ASA2-3-1:1:1 | 644 | Anthranilate Synthase alpha 2 subunit |
| I-SETit.CNT-1-1:1:1 | 645 | 2-C-methyl-D-erythritol 4-phosphate cytidylyltransferase |
| I-SETit.CNT-2-1:1:1 | 646 | 2-C-methyl-D-erythritol 4-phosphate cytidylyltransferase |
| I-SETit.CNT-3-1:1:1 | 647 | 2-C-methyl-D-erythritol 4-phosphate cytidylyltransferase |
| I-SETit.Cys-1-1:1:1 | 648 | Cystein protease |
| I-SETit.Cys-2-1:1:1 | 649 | Cystein protease |
| I-SETit.Cys-3-1:1:1 | 650 | Cystein protease |
| I-SETit.DHDPS-1-1:1:1 | 651 | Dihydrodipicolinate synthase precursor, chloroplastic |
| I-SETit.DHDPS-2-1:1:1 | 652 | Dihydrodipicolinate synthase precursor, chloroplastic |
| I-SETit.DnaJ_1-1:1:1 | 653 | Heat shock protein |
| I-SETit.DnaJ2-1:1:1 | 654 | Heat shock protein |
| I-SETit.DnaJ2-1:1:2 | 655 | Heat shock protein |
| I-SETit.DnaJ3-2-1:1:1 | 656 | Heat shock protein |
| I-SETit.DnaK10-1:1:1 | 657 | Heat shock protein |
| I-SETit.DnaK10-1:1:2 | 658 | Heat shock protein |
| I-SETit.DnaK1-1:1:1 | 659 | Heat shock protein |
| I-SETit.DnaK1-1:1:2 | 660 | Heat shock protein |
| I-SETit.DnaK1-1:1:3 | 661 | Heat shock protein |
| I-SETit.DnaK2-1:1:1 | 662 | Heat shock protein |
| I-SETit.DnaK5-1:1:1 | 663 | Heat shock protein |
| I-SETit.DnaK5-1:1:2 | 664 | Heat shock protein |
| I-SETit.DnaK6-1:1:1 | 665 | Heat shock protein |
| I-SETit.DnaK6-1:1:2 | 666 | Heat shock protein |
| I-SETit.DnaK8-1:1:1 | 667 | Heat shock protein |
| I-SETit.DnaK8-1:1:2 | 668 | Heat shock protein |
| I-SETit.DnaK8-1:1:3 | 669 | Heat shock protein |
| I-SETit.DnaK9-1:1:1 | 670 | Heat shock protein |
| I-SETit.DnaK9-1:1:2 | 671 | Heat shock protein |
| I-SETit.DnaK9-1-1:1:1 | 672 | Heat shock protein |
| I-SETit.eEF1a_1-1:1:1 | 673 | Elongation factor 1 alpha |
| I-SETit.eEF1a_1-1:1:2 | 674 | Elongation factor 1 alpha |
| I-SETit.eEF1a_2-1:1:1 | 675 | Elongation factor 1 alpha |
| I-SETit.eEF1a_2-1:1:2 | 676 | Elongation factor 1 alpha |
| I-SETit.eEF1a_3-1:1:1 | 677 | Elongation factor 1 alpha |
| I-SETit.eEF1a_3-1:1:2 | 678 | Elongation factor 1 alpha |
| I-SETit.eEF1a_4-1:1:1 | 679 | Elongation factor 1 alpha |
| I-SETit.eEF1a_4-1:1:2 | 680 | Elongation factor 1 alpha |
| I-SETit.eEF1a_5-1:1:1 | 681 | Elongation factor 1 alpha |
| I-SETit.eEF1a_5-1:1:2 | 682 | Elongation factor 1 alpha |
| I-SETit.eEF1a_6-1:1:1 | 683 | Elongation factor 1 alpha |
| I-SETit.eEF1a_6-1:1:2 | 684 | Elongation factor 1 alpha |
| I-SETit.eEF1a_7-1:1:1 | 685 | Elongation factor 1 alpha |
| I-SETit.eEF1a_7-1:1:2 | 686 | Elongation factor 1 alpha |
| I-SETit.eEF1a_7-1:1:3 | 687 | Elongation factor 1 alpha |
| I-SETit.eEF1g_1-1:1:1 | 688 | Elongation Factor 1 gamma |
| I-SETit.eEF1g_2-1:1:1 | 689 | Elongation Factor 1 gamma |
| I-SETit.eEF1g_2-1:1:2 | 690 | Elongation Factor 1 gamma |
| I-SETit.eEF1g_2-1:1:3 | 691 | Elongation Factor 1 gamma |
| I-SETit.eEF1g_3-1:1:1 | 692 | Elongation Factor 1 gamma |
| I-SETit.eEF1g_3-1:1:2 | 693 | Elongation Factor 1 gamma |
| I-SETit.eEF1g_4-1:1:1 | 694 | Elongation Factor 1 gamma |
| I-SETit.eEF1g_4-1:1:2 | 695 | Elongation Factor 1 gamma |
| I-SETit.eEF1g3-2-1:1:1 | 696 | Elongation Factor 1 gamma |
| I-SETit.eEF1g3-3-1:1:1 | 697 | Elongation Factor 1 gamma |
| I-SETit.eEF2-1:1:1 | 698 | Elongation Factor 2 |
| I-SETit.eEF2-1:1:2 | 699 | Elongation Factor 2 |
| I-SETit.eEF2-1:1:3 | 700 | Elongation Factor 2 |
| I-SETit.eIF5A1-2-1:1:1 | 701 | Elongation Factor 5 alpha |
| I-SETit.eIF5A1-3-1:1:1 | 702 | Elongation Factor 5 alpha |

TABLE 1-continued

Regulatory elements and corresponding promoters, leaders and introns; and transit (localization) sequences.

| Annotation | SEQ ID NO: | Description |
|---|---|---|
| I-SETit.eIF5A1-4-1:1:1 | 703 | Elongation Factor 5 alpha |
| I-SETit.eIF5A1-5-1:1:1 | 704 | Elongation Factor 5 alpha |
| I-SETit.eIF5A2-1-1:1:1 | 705 | Elongation Factor 5 alpha |
| I-SETit.eIF5A2-2-1:1:1 | 706 | Elongation Factor 5 alpha |
| I-SETit.eIF5A2-2-1:1:2 | 707 | Elongation Factor 5 alpha |
| I-SETit.eIF5A2-3-1:1:1 | 708 | Elongation Factor 5 alpha |
| I-SETit.eIF5A2-4-1:1:1 | 709 | Elongation Factor 5 alpha |
| I-SETit.eIF5A2-5-1:1:1 | 710 | Elongation Factor 5 alpha |
| I-SETit.eIF5A3-2-1:1:1 | 711 | Elongation Factor 5 alpha |
| I-SETit.eIF5A3-3-1:1:1 | 712 | Elongation Factor 5 alpha |
| I-SETit.eIF5A3-4-1:1:1 | 713 | Elongation Factor 5 alpha |
| I-SETit.eIF5A3-5-1:1:1 | 714 | Elongation Factor 5 alpha |
| I-SETit.Ein3-1:1: | 715 | Ethylene-insensitive 3-like protein |
| I-SETit.EIN3-1:1 | 716 | Ethylene-insensitive 3-like protein |
| I-SETit.GAD_1-1:1:1 | 717 | UDP-glucuronic acid decarboxylase |
| I-SETit.GAD_2-1:1:1 | 718 | UDP-glucuronic acid decarboxylase |
| I-SETit.GAD_3-1:1:1 | 719 | UDP-glucuronic acid decarboxylase |
| I-SETit.GAD_4-1:1:1 | 720 | UDP-glucuronic acid decarboxylase |
| I-SETit.Grf1-1:1:1 | 721 | Putative growth-regulating factor |
| I-SETit.Grf2-1:1:1 | 722 | Putative growth-regulating factor |
| I-SETit.Grf3-1:1:1 | 723 | Putative growth-regulating factor |
| I-SETit.Grp-1:1: | 724 | Glycine-rich RNA binding protein |
| I-SETit.HDh-1:1:1 | 725 | Aquaporin |
| I-SETit.I-SETit.PIP1-1_2-1:1:1 | 726 | Aquaporin |
| I-SETit.I-SETit.PIP1-1_3-1:1:1 | 727 | Aquaporin |
| I-SETit.I-SETit.PIP2-2_2-1:1:1-1:1:1 | 728 | Aquaporin |
| I-SETit.LSm80-1-1:1:1 | 729 | U6 snRNA-associated Sm-like protein LSm80 |
| I-SETit.LSm80-2-1:1:1 | 730 | U6 snRNA-associated Sm-like protein LSm80 |
| I-SETit.LSm80-3-1:1:1 | 731 | U6 snRNA-associated Sm-like protein LSm80 |
| I-SETit.LSm80-4-1:1:1 | 732 | U6 snRNA-associated Sm-like protein LSm80 |
| I-SETit.LSm8-1-1:1:1 | 733 | U6 snRNA-associated Sm-like protein LSm8 |
| I-SETit.LSm8-4-1:1:1 | 734 | U6 snRNA-associated Sm-like protein LSm8 |
| I-SETit.MDH-1:1:1 | 735 | Putative NAD-malate dehydrogenase |
| I-SETit.Nab-1:1:1 | 736 | Nucleic acid binding protein |
| I-SETit.NAB-1:1:1 | 737 | Nucleic acid binding protein |
| I-SETit.NADP-Me-1:1:1 | 738 | NADP malate enzyme |
| I-SETit.NADP-Me-1:1:2 | 739 | NADP malate enzyme |
| I-SETit.PGK1-1:1:1 | 740 | Phosphoglycerate kinase |
| I-SETit.PGK1-1:1:2 | 741 | Phosphoglycerate kinase |
| I-SETit.Pgk1-1-1:1:1 | 742 | Phosphoglycerate kinase |
| I-SETit.Pgk1-2-1:1:1 | 743 | Phosphoglycerate kinase |
| I-SETit.PGK3_1-1:1:1 | 744 | Phosphoglycerate kinase |
| I-SETit.PIP1_3_2-1:1:1 | 745 | Aquaporin |
| I-SETit.PIP1-1_2-1:1:1 | 746 | Aquaporin |
| I-SETit.PIP1-1_3-1:1:1 | 747 | Aquaporin |
| I-SETit.PIP1-3_3-1:1:1 | 748 | Aquaporin |
| I-SETit.PIP1-4_3-1:1:1 | 749 | Aquaporin |
| I-SETit.PIP2-2_2-1:1:1 | 750 | Aquaporin |
| I-SETit.PIP2-2_3-1:1:1 | 751 | Aquaporin |
| I-SETit.PIP2-5_2-1:1:1 | 752 | Aquaporin |
| I-SETit.PIP2-5_3-1:1:1 | 753 | Aquaporin |
| I-SETit.PPR-1:1:1 | 754 | Pentatricopeptide repeat-containing protein |
| I-SETit.Prx17-1-1:1:1 | 755 | Peroxidase 17 |
| I-SETit.Prx3-1-1:1:1 | 756 | Peroxidase 3 |
| I-SETit.Prx3-2-1:1:1 | 757 | Peroxidase 3 |
| I-SETit.PSRP-3-1:1:1 | 758 | Plastid and cyanobacterial ribosomal protein |
| I-SETit.RbcS_1-1:1:1 | 759 | Small subunit RUBISCO |
| I-SETit.RbcS_2-1:1:1 | 760 | Small subunit RUBISCO |
| I-SETit.RbcS_3-1:1:1 | 761 | Small subunit RUBISCO |
| I-SETit.RbcS_4-1:1:1 | 762 | Small subunit RUBISCO |
| I-SETit.Rps7-2_2-1:1:1 | 763 | 40S-7S-2 family protein |
| I-SETit.Rps7-2_3-1:1:1 | 764 | 40S-7S-2 family protein |
| I-SETit.Rps7-2_4-1:1:1 | 765 | 40S-7S-2 family protein |
| I-SETit.SBD-1-1:1:1 | 766 | Shwachman-Bodian-Diamond syndrome protein |
| I-SETit.SBD-3-1:1:1 | 767 | Shwachman-Bodian-Diamond syndrome protein |
| I-SETit.SBS-2-1:1:1 | 768 | Shwachman-Bodian-Diamond syndrome protein |
| I-SETit.SETit.eEF1g_4-1:1:1 | 769 | Elongation Factor 1 gamma |
| I-SETit.ThioR-1:1:1 | 770 | Thioreductase |
| I-SETit.TubA2_3-1:1:2 | 771 | Tubulin A2 |
| I-SETit.TubA2-1:1:1 | 772 | Tubulin A2 |

TABLE 1-continued

Regulatory elements and corresponding promoters, leaders and introns; and transit (localization) sequences.

| Annotation | SEQ ID NO: | Description |
| --- | --- | --- |
| I-SETit.TubA2-2-1:1:1 | 773 | Tubulin A2 |
| I-SETit.TubA2-3-1:1:1 | 774 | Tubulin A2 |
| I-SETit.TubA3_1-1:1:2 | 775 | Tubulin A3 |
| I-SETit.TubA3_2-1:1:2 | 776 | Tubulin A3 |
| I-SETit.Ubq5-1:1:1 | 777 | Ubiquitin 5 |
| I-SETit.Wx1-1-1:1:1 | 778 | Putative granule bound starch synthase |
| T-SETit.36384-1:1:1 | 779 | Cluster 36384 |
| T-SETit.37025-1:1:1 | 780 | Cluster 37025 |
| T-SETit.37470-1:1:1 | 781 | Cluster 37470 |
| T-SETit.Ams2-1:1:1 | 782 | S-adenosylmethionine synthetase 2 |
| T-SETit.Atps-1:1:1 | 783 | ATP synthase subunit gamma |
| T-SETit.Cab-1:1:1 | 784 | Chlorophyll a/b binding protein |
| T-SETit.Cab1-1:1:1 | 785 | Chlorophyll a/b binding protein |
| T-SETit.Ctpt-1:1:1 | 786 | Triose phosphate/phosphate translocator, chloroplast precursor |
| T-SETit.DnaK-1:1:1 | 787 | Heat shock protein |
| T-SETit.Fba-1:1:2 | 788 | Fructose-bisphosphate aldolase |
| T-SETit.Fba-1:1:3 | 789 | Fructose-bisphosphate aldolase |
| T-SETit.Fba-1:1:4 | 790 | Fructose-bisphosphate aldolase |
| T-SETit.Gapdh-1:1:1 | 791 | Glyceraldehyde-3-phosphate dehydrogenase |
| T-SETit.MES2_nno-1:1:1 | 792 | Methionine synthase 2 |
| T-SETit.Oep-1:1:1 | 793 | 33 kDa oxygen evolving protein |
| T-SETit.Pea-1:1:1 | 794 | Proton-exporting ATPase |
| T-SETit.Pod-1:1:1 | 795 | pyruvate orthophosphate dikinase |
| T-SETit.Ppc-1:1:1 | 796 | Phosphoenolpyruvate carboxylase |
| T-SETit.Psi-K-1:1:1 | 797 | Photosystem I reaction center subunit |
| T-SETit.Psi-L-1:1:1 | 798 | Photosystem I reaction center subunit |
| T-SETit.Rfe-s-1:1:1 | 799 | Rieske Fe—S |
| T-SETit.TubA-1:1:1 | 800 | Tubulin A |
| T-contig00388 | 801 | Root 3' UTR |
| T-contig05482 | 802 | Root 3' UTR |
| T-contig08555 | 803 | Root 3' UTR |
| T-contig08556 | 804 | Root 3' UTR |
| T-contig09485 | 805 | Root 3' UTR |
| T-contig13749 | 806 | Root 3' UTR |
| T-contig16157 | 807 | Root 3' UTR |
| T-contig18936 | 808 | Root 3' UTR |
| T-contig18994 | 809 | Root 3' UTR |
| T-contig21387 | 810 | Root 3' UTR |
| T-contig23385 | 811 | Root 3' UTR |
| T-contig24188 | 812 | Root 3' UTR |
| T-contig24188 | 813 | Root 3' UTR |
| T-contig24832 | 814 | Root 3' UTR |
| T-contig24890 | 815 | Root 3' UTR |
| T-contig24916 | 816 | Root 3' UTR |
| T-contig25097 | 817 | Root 3' UTR |
| T-contig25509 | 818 | Root 3' UTR |
| T-contig25584 | 819 | Root 3' UTR |
| T-contig26532 | 820 | Root 3' UTR |
| T-contig28013 | 821 | Root 3' UTR |
| T-contig29922 | 822 | Root 3' UTR |
| T-contig34261 | 823 | Root 3' UTR |
| T-contig34311 | 824 | Root 3' UTR |
| T-contig34749 | 825 | Root 3' UTR |
| T-contig35408 | 826 | Root 3' UTR |
| T-contig35550 | 827 | Root 3' UTR |
| T-contig35785 | 828 | Root 3' UTR |
| T-contig35943 | 829 | Root 3' UTR |
| T-contig36050 | 830 | Root 3' UTR |
| T-contig36266 | 831 | Root 3' UTR |
| T-contig36378 | 832 | Root 3' UTR |
| T-contig36502 | 833 | Root 3' UTR |
| T-contig36728 | 834 | Root 3' UTR |
| T-contig36811 | 835 | Root 3' UTR |
| T-contig36883 | 836 | Root 3' UTR |
| T-contig37316 | 837 | Root 3' UTR |
| T-contig37476 | 838 | Root 3' UTR |
| T-contig37510 | 839 | Root 3' UTR |
| T-contig37704 | 840 | Root 3' UTR |
| T-contig37883 | 841 | Root 3' UTR |
| T-contig37920 | 842 | Root 3' UTR |
| T-contig37959 | 843 | Root 3' UTR |
| T-contig37976 | 844 | Root 3' UTR |
| T-contig38003 | 845 | Root 3' UTR |

TABLE 1-continued

Regulatory elements and corresponding promoters, leaders and introns; and transit (localization) sequences.

| Annotation | SEQ ID NO: | Description |
|---|---|---|
| T-SETIT-28JUL09-CLUS3016_12 | 846 | Root 3' UTR |
| T-10SETIT-28JUL09-CLUS1332_4 | 847 | Constitutive 3' UTR |
| T-17SETIT-28JUL09-CLUS1910_15 | 848 | Constitutive 3' UTR |
| T-7SETIT-28JUL09-CLUS2844_11 | 849 | Constitutive 3' UTR |
| T-contig00006 | 850 | Constitutive 3' UTR |
| T-contig00142 | 851 | Constitutive 3' UTR |
| T-contig00191 | 852 | Constitutive 3' UTR |
| T-contig00205 | 853 | Constitutive 3' UTR |
| T-contig00242 | 854 | Constitutive 3' UTR |
| T-contig00263 | 855 | Constitutive 3' UTR |
| T-contig01883 | 856 | Constitutive 3' UTR |
| T-contig02157 | 857 | Constitutive 3' UTR |
| T-contig02856 | 858 | Constitutive 3' UTR |
| T-contig02883 | 859 | Constitutive 3' UTR |
| T-contig04253 | 860 | Constitutive 3' UTR |
| T-contig05397 | 861 | Constitutive 3' UTR |
| T-contig05720 | 862 | Constitutive 3' UTR |
| T-contig10626 | 863 | Constitutive 3' UTR |
| T-contig10874 | 864 | Constitutive 3' UTR |
| T-contig11193 | 865 | Constitutive 3' UTR |
| T-contig14970 | 866 | Constitutive 3' UTR |
| T-contig26892 | 867 | Constitutive 3' UTR |
| T-contig32186 | 868 | Constitutive 3' UTR |
| T-contig32187 | 869 | Constitutive 3' UTR |
| T-contig33439 | 870 | Constitutive 3' UTR |
| T-contig33682 | 871 | Constitutive 3' UTR |
| T-contig34270 | 872 | Constitutive 3' UTR |
| T-contig34378 | 873 | Constitutive 3' UTR |
| T-contig35132 | 874 | Constitutive 3' UTR |
| T-contig35270 | 875 | Constitutive 3' UTR |
| T-contig35388 | 876 | Constitutive 3' UTR |
| T-contig35412 | 877 | Constitutive 3' UTR |
| T-contig35488 | 878 | Constitutive 3' UTR |
| T-contig35982 | 879 | Constitutive 3' UTR |
| T-contig36384 | 880 | Constitutive 3' UTR |
| T-contig36588 | 881 | Constitutive 3' UTR |
| T-contig36702 | 882 | Constitutive 3' UTR |
| T-contig36980 | 883 | Constitutive 3' UTR |
| T-contig36992 | 884 | Constitutive 3' UTR |
| T-contig36993 | 885 | Constitutive 3' UTR |
| T-contig37025 | 886 | Constitutive 3' UTR |
| T-contig37162 | 887 | Constitutive 3' UTR |
| T-contig37351 | 888 | Constitutive 3' UTR |
| T-contig37386 | 889 | Constitutive 3' UTR |
| T-contig37448 | 890 | Constitutive 3' UTR |
| T-contig37456 | 891 | Constitutive 3' UTR |
| T-contig37638 | 892 | Constitutive 3' UTR |
| T-contig37732 | 893 | Constitutive 3' UTR |
| T-contig37897 | 894 | Constitutive 3' UTR |
| T-contig37927 | 895 | Constitutive 3' UTR |
| T-contig37962 | 896 | Constitutive 3' UTR |
| T-contig37980 | 897 | Constitutive 3' UTR |
| T-SETIT-28JUL09-CLUS11107_1 | 898 | Constitutive 3' UTR |
| T-SETIT-28JUL09-CLUS11705_1 | 899 | Constitutive 3' UTR |
| T-SETIT-28JUL09-CLUS11899_1 | 900 | Constitutive 3' UTR |
| T-SETIT-28JUL09-CLUS12698_2 | 901 | Constitutive 3' UTR |
| T-SETIT-28JUL09-CLUS13580_1 | 902 | Constitutive 3' UTR |
| T-SETIT-28JUL09-CLUS1404_1 | 903 | Constitutive 3' UTR |
| T-SETIT-28JUL09-CLUS14743_1 | 904 | Constitutive 3' UTR |
| T-SETIT-28JUL09-CLUS181186_1 | 905 | Constitutive 3' UTR |
| T-SETIT-28JUL09-CLUS19095_1 | 906 | Constitutive 3' UTR |

TABLE 1-continued

Regulatory elements and corresponding promoters, leaders and introns; and transit (localization) sequences.

| Annotation | SEQ ID NO: | Description |
|---|---|---|
| T-SETIT-28JUL09-CLUS1910_13 | 907 | Constitutive 3' UTR |
| T-SETIT-28JUL09-CLUS1910_14 | 908 | Constitutive 3' UTR |
| T-SETIT28JUL09CLUS1910_16 | 909 | Constitutive 3' UTR |
| T-SETIT28JUL09CLUS1910_17 | 910 | Constitutive 3' UTR |
| T-SETIT-28JUL09-CLUS1910_18 | 911 | Constitutive 3' UTR |
| T-SETIT-28JUL09-CLUS1910_19 | 912 | Constitutive 3' UTR |
| T-SETIT-28JUL09-CLUS2157_4 | 913 | Constitutive 3' UTR |
| T-SETIT-28JUL09-CLUS2166_1 | 914 | Constitutive 3' UTR |
| T-SETIT-28JUL09-CLUS243_3 | 915 | Constitutive 3' UTR |
| T-SETIT-28JUL09-CLUS3485_1 | 916 | Constitutive 3' UTR |
| T-SETIT-28JUL09-CLUS364_1 | 917 | Constitutive 3' UTR |
| T-SETIT-28JUL09-CLUS36567_1 | 918 | Constitutive 3' UTR |
| T-SETIT-28JUL09-CLUS42130_1 | 919 | Constitutive 3' UTR |
| T-SETIT-28JUL09-CLUS52844_1 | 920 | Constitutive 3' UTR |
| T-SETIT-28JUL09-CLUS7004_1 | 921 | Constitutive 3' UTR |
| T-SETIT-28JUL09-CLUS83_23 | 922 | Constitutive 3' UTR |
| T-SETIT-28JUL09-CLUS937_1 | 923 | Constitutive 3' UTR |
| T-SETIT-28JUL09-CLUS95524_1 | 924 | Constitutive 3' UTR |

Two size variants of the Foxtail millet Act8 (Actin 8) promoter are presented in Table 1. Alignment of the size variants for the Actin 8 promoter is provided in FIGS. 1a through 1c. The promoter, P-SETit.Act8-1:1:5 (SEQ ID NO: 24) is 1419 nucleotides in length. The promoter, P-SETit.Act8-1:1:6 (SEQ ID NO: 25) is comprised of a 5' deletion of P-SETit.Act8-1:1:5 (SEQ ID NO: 24) and is 902 nucleotides in length.

Two size variants of the Foxtail millet Alc1 promoter are presented in Table 1. Alignment of the size variants for the Alc1 promoter is provided in FIGS. 2a through 2c. The promoter, P-SETit.Alc1-1:1:1 (SEQ ID NO: 28) is 1577 nucleotides in length. The promoter, P-SETit.Alc1-1:1:2 (SEQ ID NO: 29) is comprised of a 5' deletion of P-SETit.Alc1-1:1:1 (SEQ ID NO: 28) and is 412 nucleotides in length.

Two size variants of the Foxtail millet Cys promoter are presented in Table 1. Alignment of the size variants for the Cys promoter is provided in FIGS. 3a through 3f. The promoter, P-SETit.Cys-1:1:2 (SEQ ID NO: 45) is 3277 nucleotides in length. The promoter, P-SETit.Cys-1:1:3 (SEQ ID NO: 46) is comprised of a 5' deletion of P-SETit.Cys-1:1:2 (SEQ ID NO: 45) and is 2020 nucleotides in length.

Two size variants of the Foxtail millet Dzs promoter are presented in Table 1. Alignment of the size variants for the Dzs promoter is provided in FIGS. 4a through 4f. The promoter, P-SETit.Dzs-1:1:4 (SEQ ID NO: 47) is 3508 nucleotides in length. The promoter, P-SETit.Dzs-1:1:5 (SEQ ID NO: 48) is comprised of a 5' deletion of P-SETit.Dzs-1:1:4 (SEQ ID NO: 47) and is 1008 nucleotides in length.

Two size variants of the Foxtail millet Gst promoter are presented in Table 1. Alignment of the size variants for the Gst promoter is provided in FIGS. 5a through 5c. The promoter, P-SETit.Gst-1:1:1 (SEQ ID NO: 58) is 1681 nucleotides in length. The promoter, P-SETit.Gst-1:1:2 (SEQ ID NO: 59) is comprised of a 5' deletion of P-SETit.Gst-1:1:1 (SEQ ID NO: 58) and is 428 nucleotides in length.

Two size variants of the Foxtail millet Ifr promoter are presented in Table 1. Alignment of the size variants for the Ifr promoter is provided in FIGS. 6a through 6c. The promoter, P-SETit.Ifr-1:1:2 (SEQ ID NO: 60) is 1280 nucleotides in length. The promoter, P-SETit.Ifr-1:1:3 (SEQ ID NO: 61) is comprised of a 5' deletion of P-SETit.Ifr-1:1:2 (SEQ ID NO: 60) and is 275 nucleotides in length.

Two size variants of the Foxtail millet Nrt2 promoter are presented in Table 1. Alignment of the size variants for the Nrt2 promoter is provided in FIGS. 7a through 7d. The promoter, P-SETit.Nrt2-1:1:2 (SEQ ID NO: 64) is 1866 nucleotides in length. The promoter, P-SETit.Nrt2-1:1:3 (SEQ ID NO: 65) is comprised of a 5' deletion of P-SETit.Nrt2-1:1:2 (SEQ ID NO: 64) and is 382 nucleotides in length.

Two size variants of the Foxtail millet Ppc promoter are presented in Table 1. Alignment of the size variants for the Ppc promoter is provided in FIGS. 8a through 8e. The promoter, P-SETit.Ppc-1:1:3 (SEQ ID NO: 74) is 2722 nucleotides in length. The promoter, P-SETit.Ppc-1:1:4 (SEQ ID NO: 75) is comprised of a 5' deletion of P-SETit.Ppc-1:1:3 (SEQ ID NO: 74) and is 1882 nucleotides in length.

Two size variants of the Foxtail millet Prx3 promoter are presented in Table 1. Alignment of the size variants for the Prx3 promoter is provided in FIGS. 9a through 9f. The promoter, P-SETit.Prx3-1:1:4 (SEQ ID NO: 83) is 3354 nucleotides in length. The promoter, P-SETit.Prx3-1:1:3 (SEQ ID NO: 82) is comprised of a 5' deletion of P-SETit.Prx3-1:1:4 (SEQ ID NO: 83) and is 1908 nucleotides in length.

Three size variants of the Foxtail millet Rcc3 promoter are presented in Table 1. Alignment of the size variants for the Rcc3 promoter is provided in FIGS. 10a through 10f. The promoter, P-SETit.Rcc3-1:1:1 (SEQ ID NO: 88) is 2062 nucleotides in length. The promoter, P-SETit.Rcc3-1:1:16 (SEQ ID NO: 91) is comprised of a 5' deletion of P-SETit.Rcc3-1:1:1 (SEQ ID NO: 88) and is 2024 nucleotides in length. The promoter, P-SETit.Rcc3-1:1:10 (SEQ ID NO: 89) is comprised of a 5' deletion of P-SETit.Rcc3-1:1:1 (SEQ ID NO: 88) and is 1563 nucleotides in length. The promoter, P-SETit.Rcc3-1:1:11 (SEQ ID NO: 90) is comprised of a 5' deletion of P-SETit.Rcc3-1:1:1 (SEQ ID NO: 88) and is 915 nucleotides in length.

Two size variants of the Foxtail millet Ssp1 promoter are presented in Table 1. Alignment of the size variants for the Ssp1 promoter is provided in FIGS. 11a through 11b. The promoter, P-SETit.Ssp1-1:1:1 (SEQ ID NO: 93) is 1128 nucleotides in length. The promoter, P-SETit.Ssp1-1:1:2 (SEQ ID NO: 94) is comprised of a 5' deletion of P-SETit.Ssp1-1:1:1 (SEQ ID NO: 93) and is 479 nucleotides in length.

Two size variants of the Foxtail millet Tip promoter are presented in Table 1. Alignment of the size variants for the Tip promoter is provided in FIGS. 12a through 12d. The promoter, P-SETit.Tip-1:1:4 (SEQ ID NO: 97) is 2108 nucleotides in length. The promoter, P-SETit.Tip-1:1:1 (SEQ ID NO: 96) is comprised of a 5' deletion of P-SETit.Tip-1:1:4 (SEQ ID NO: 97) and is 917 nucleotides in length.

Two size variants of the Foxtail millet TubA2-1 promoter are presented in Table 1. Alignment of the size variants for the TubA2-1 promoter is provided in FIGS. 13a through 13d. The promoter, P-SETit.TubA2-1-1:1:2 (SEQ ID NO: 98) is 1593 nucleotides in length. The promoter, P-SETit.TubA2-1-1:1:3 (SEQ ID NO: 99) is comprised of a 5' deletion of P-SETit.TubA2-1-1:1:2 (SEQ ID NO: 98) and is 856 nucleotides in length.

Two size variants of the Foxtail millet Ubq1 promoter are presented in Table 1. Alignment of the size variants for the Ubq1 promoter is provided in FIGS. 14a through 14c. The promoter, P-SETit.Ubq1-1:1:1 (SEQ ID NO: 102) is 1492 nucleotides in length. The promoter, P-SETit.Ubq1-1:1:3 (SEQ ID NO: 103) is comprised of a 5' deletion of P-SETit.Ubq1-1:1:1 (SEQ ID NO: 102) and is 680 nucleotides in length.

Compositions derived from any of the promoters presented as SEQ ID NOS: 23 through 105 and SEQ ID NOS: 353 through 536 comprised of internal or 5' deletions can be built using methods known in the art to improve expression, by removing elements that have either positive or negative effects on expression; or duplicating elements that have either positive or negative effects on expression; or duplicating or removing elements that have tissue or cell specific effects on expression. Compositions derived from any of the promoters presented as SEQ ID NOS: 23 through 105 and SEQ ID NOS: 353 through 536 comprised of 3' deletions in which the TATA box element or equivalent sequence thereof and downstream sequence is removed can be used to make enhancer elements. Further deletions can be made to remove any elements that have either positive or negative; or tissue specific; or cell specific; or timing specific (such as, but not limited to, circadian rhythms) effects on expression. Any of the promoters presented as SEQ ID NOS: 23 through 105 and SEQ ID NOS: 353 through 536 and the fragments or enhancers derived there from can be used to make chimeric transcriptional regulatory element compositions comprised of any of the promoters presented as SEQ ID NOS: 23 through 105 and SEQ ID NOS: 353 through 536 and the fragments or enhancers derived there from operably linked to other enhancers and promoters. The efficacy of the modifications, duplications or deletions described above on the desired expression aspects of a particular transgene are tested empirically in stable and transient plant assays, since the effect of such alterations to the native promoter composition are not readily predictable and require empirical testing to validate such effects.

The leader sequences (5' UTR) presented as SEQ ID NOS: 106 through 171 and SEQ ID NOS: 537 through 588 may be comprised of regulatory elements or may adopt secondary structures that can have an effect on transcription or translation of a transgene. The leader sequences presented as SEQ ID NOS: 106 through 171 and SEQ ID NOS: 537 through 588 can be used to make chimeric regulatory elements that affect transcription or translation of a transgene. In addition, the leader sequences presented as SEQ ID NOS: 106 through 171 and SEQ ID NOS: 537 through 588 can be used to make chimeric leader sequences which affect transcription or translation of a transgene.

Compositions derived from any of the introns presented as SEQ ID NOS: 172 through 267, SEQ ID NOS: 317 through 323 and SEQ ID NOS: 589 through 778 can be comprised of internal deletions or duplications of cis regulatory elements; or alterations of the 5' and 3' sequences comprising the intron/exon splice junctions, can be used to improve expression or specificity of expression when operably linked to a promoter+leader or chimeric promoter+leader and coding sequence. Alterations of the 5' and 3' regions comprising the intron/exon splice junction can also be made to reduce the potential for introduction of false start and stop codons begin produced in the resulting transcript after processing and splicing of the messenger RNA. The introns are tested empirically as described below to determine the intron's effect on expression of a transgene.

Example 2

Analysis of Regulatory Elements Driving GUS in Transgenic Corn

Corn plants were transformed with plant expression vectors containing the test regulatory elements driving expression of the β-glucuronidase (GUS) transgene, and the resulting plants were analyzed for GUS protein expression.

Corn plants were transformed with the plant GUS expression constructs, listed in Table 2, below. Regulatory elements and chimeric regulatory elements presented in example 1 were cloned into a base plant expression vector using standard methods known in the art. The resulting plant expression vectors contained a right border region from *Agrobacterium tumefaciens*, a first transgene cassette to test the regulatory or chimeric regulatory element comprised of, a regulatory or chimeric regulatory element, operably linked to an intron derived from the HSP70 heat shock protein of Zea mays (I-Zm.DnaK-1:1:1, SEQ ID NO: 1102), operably linked to a coding sequence for β-glucuronidase (GUS) that either possessed a processable intron (GUS-2, SEQ ID NO: 1091) or no intron (GUS-1, SEQ ID NO: 1090), operably linked to the Nopaline synthase 3' termination region from *A. tumefaciens* (T-AGRtu.nos-1:1:13, SEQ ID NO: 1088) or the 3' termination region from the rice lipid transfer protein gene (T-Os.LTP-1:1:1, SEQ ID NO: 1089); a second transgene selection cassette used for selection of transformed plant cells that conferred resistance to the herbicide glyphosate (driven by the rice Actin 1 transcriptional regulatory element group, SEQ ID NO: 1098), or alternatively, the antibiotic kanamycin (driven by the rice Actin 1 transcriptional regulatory element group, SEQ ID NO: 1098) and a left border region from *A. tumefaciens*. The resulting plasmids, pMON109728, pMON112215, pMON116789, pMON116816, pMON116818, pMON116820, pMON116829, pMON120698, pMON120699, pMON120700, pMON120701, pMON120702, pMON120703, pMON120704, pMON120705, pMON120706, pMON120709, pMON120710, pMON120711, pMON120712, pMON120713, pMON127440, pMON127441, pMON127442, pMON127443, pMON127444, pMON127445, pMON127446, pMON127447, pMON127448, pMON127449 and pMON132037 were used to transform corn plants.

TABLE 2

Binary Plant Transformation Constructs, Regulatory or chimeric regulatory elements, GUS and 3' UTRs.

| Construct | Regulatory Elements | GUS | 3' UTR |
|---|---|---|---|
| pMON109728 | EXP-FMV.35S-SETit.Tip (SEQ ID NO: 8)<br>E-FMV.35S-1:1:2 (SEQ ID NO: 351)<br>P-SETit.Tip-1:1:1 (SEQ ID NO: 96)<br>L-SETit.Tip-1:1:1 (SEQ ID NO: 165) | GUS-1 | T-AGRtu.nos-1:1:13 |
| pMON112215 | P-SETit.Rcc3-1:1:1 (SEQ ID NO: 88)<br>L-SETit.Rcc3-1:1:1 (SEQ ID NO: 161) | GUS-1 | T-AGRtu.nos-1:1:13 |
| pMON116789 | P-SETit.Rcc3-1:1:11 (SEQ ID NO: 90)<br>L-SETit.Rcc3-1:1:2 (SEQ ID NO: 162) | GUS-1 | T-AGRtu.nos-1:1:13 |
| pMON116816 | P-SETit.Rcc3-1:1:11 (SEQ ID NO: 90)<br>L-SETit.Rcc3-1:1:2 (SEQ ID NO: 162) | GUS-1 | T-AGRtu.nos-1:1:13 |
| pMON116818 | P-SETit.Pox-1:1:1 (SEQ ID NO: 73)<br>L-SETit.Pox-1:1:1 (SEQ ID NO: 147) | GUS-1 | T-AGRtu.nos-1:1:13 |
| pMON116820 | P-SETit.Gst-1:1:1 (SEQ ID NO: 58)<br>L-SETit.Gst-1:1:1 (SEQ ID NO: 135) | GUS-1 | T-AGRtu.nos-1:1:13 |
| pMON116829 | P-SETit.Rcc3-1:1:10 (SEQ ID NO: 89)<br>L-SETit.Rcc3-1:1:2 (SEQ ID NO: 162) | GUS-1 | T-AGRtu.nos-1:1:13 |
| pMON120698 | EXP-FMV.35S-SETit.Rcc3:a (SEQ ID NO: 6)<br>E-FMV.35S-1:1:2 (SEQ ID NO: 351)<br>P-SETit.Rcc3-1:1:10 (SEQ ID NO: 89)<br>L-SETit.Rcc3-1:1:2 (SEQ ID NO: 162) | GUS-2 | T-Os.LTP-1:1:1 |
| pMON120699 | EXP-FMV.35S-SETit.Gst:a (SEQ ID NO: 2)<br>E-FMV.35S-1:1:2 (SEQ ID NO: 351)<br>P-SETit.Gst-1:1:1 (SEQ ID NO: 58)<br>L-SETit.Gst-1:1:1 (SEQ ID NO: 135) | GUS-2 | T-Os.LTP-1:1:1 |
| pMON120700 | EXP-FMV.35S-SETit.Rcc3:b (SEQ ID NO: 7)<br>E-FMV.35S-1:1:2 (SEQ ID NO: 351)<br>P-SETit.Rcc3-1:1:11 (SEQ ID NO: 90)<br>L-SETit.Rcc3-1:1:2 (SEQ ID NO: 162) | GUS-2 | T-Os.LTP-1:1:1 |
| pMON120701 | EXP-FMV.35S-SETit.Pox (SEQ ID NO: 5)<br>E-FMV.35S-1:1:2 (SEQ ID NO: 351)<br>P-SETit.Pox-1:1:1 (SEQ ID NO: 73)<br>L-SETit.Pox-1:1:1 (SEQ ID NO: 147) | GUS-2 | T-Os.LTP-1:1:1 |
| pMON120702 | P-SETit.Ccoamt-1:1:2 (SEQ ID NO: 35)<br>L-SETit.Ccoamt-1:1:2 (SEQ ID NO: 116) | GUS-2 | T-Os.LTP-1:1:1 |
| pMON120703 | EXP-FMV.35S-SETit.Ccoamt (SEQ ID NO: 1)<br>E-FMV.35S-1:1:2 (SEQ ID NO: 351)<br>P-SETit.Ccoamt-1:1:2 (SEQ ID NO: 35)<br>L-SETit.Ccoamt-1:1:2 (SEQ ID NO: 116) | GUS-2 | T-Os.LTP-1:1:1 |
| pMON120704 | P-SETit.Gst-1:1:2 (SEQ ID NO: 59)<br>L-SETit.Gst-1:1:1 (SEQ ID NO: 135) | GUS-2 | T-Os.LTP-1:1:1 |
| pMON120705 | EXP-FMV.35S-SETit.Gst:b (SEQ ID NO: 3)<br>E-FMV.35S-1:1:2 (SEQ ID NO: 351)<br>P-SETit.Gst-1:1:2 (SEQ ID NO: 59)<br>L-SETit.Gst-1:1:1 (SEQ ID NO: 135) | GUS-2 | T-Os.LTP-1:1:1 |
| pMON120706 | EXP-FMV.35S-SETit.Ifr (SEQ ID NO: 4)<br>E-FMV.35S-1:1:2 (SEQ ID NO: 351)<br>P-SETit.Ifr-1:1:3 (SEQ ID NO: 61)<br>L-SETit.Ifr-1:1:1 (SEQ ID NO: 136) | GUS-2 | T-Os.LTP-1:1:1 |
| pMON120709 | P-SETit.Nrt2-1:1:3 (SEQ ID NO: 65)<br>L-SETit.Nrt2-1:1:2 (SEQ ID NO: 139) | GUS-2 | T-Os.LTP-1:1:1 |
| pMON120710 | P-SETit.Nrt2-1:1:2 (SEQ ID NO: 64)<br>L-SETit.Nrt2-1:1:2 (SEQ ID NO: 139) | GUS-2 | T-Os.LTP-1:1:1 |
| pMON120711 | P-SETit.Pip2-1:1:3 (SEQ ID NO: 71)<br>L-SETit.Pip2-1:1:1 (SEQ ID NO: 145) | GUS-2 | T-Os.LTP-1:1:1 |
| pMON120712 | P-SETit.Ifr-1:1:2 (SEQ ID NO: 60)<br>L-SETit.Ifr-1:1:1 (SEQ ID NO: 136) | GUS-2 | T-Os.LTP-1:1:1 |

TABLE 2-continued

Binary Plant Transformation Constructs, Regulatory or chimeric regulatory elements, GUS and 3' UTRs.

| Construct | Regulatory Elements | GUS | 3' UTR |
|---|---|---|---|
| pMON120713 | P-SETit.Ifr-1:1:3 (SEQ ID NO: 61)<br>L-SETit.Ifr-1:1:1 (SEQ ID NO: 136) | GUS-2 | T-Os.LTP-1:1:1 |
| pMON127440 | P-SETit.Ppc-1:1:3 (SEQ ID NO: 74)<br>L-SETit.Ppc-1:1:1 (SEQ ID NO: 148) | GUS-2 | T-Os.LTP-1:1:1 |
| pMON127441 | P-SETit.Ppc-1:1:4 (SEQ ID NO: 75)<br>L-SETit.Ppc-1:1:1 (SEQ ID NO: 148) | GUS-2 | T-Os.LTP-1:1:1 |
| pMON127442 | P-SETit.Gapdh2-1:1:3 (SEQ ID NO: 55)<br>L-SETit.Gapdh2-1:1:1 (SEQ ID NO: 133) | GUS-2 | T-Os.LTP-1:1:1 |
| pMON127443 | EXP-SETit.Ppdk:1:1 (SEQ ID NO: 14)<br>P-SETit.Ppdk-1:1:1 (SEQ ID NO: 76)<br>L-SETit.Ppdk-1:1:4 (SEQ ID NO: 150)<br>I-SETit.Ppdk-1:1:1 (SEQ ID NO: 175)<br>L-SETit.Ppdk-1:1:2 (SEQ ID NO: 149) | GUS-2 | T-Os.LTP-1:1:1 |
| pMON127444 | P-SETit.CP29-1:1:4 (SEQ ID NO: 42)<br>L-SETit.CP29-1:1:1 (SEQ ID NO: 124) | GUS-2 | T-Os.LTP-1:1:1 |
| pMON127445 | P-SETit.Cab3-1:1:3 (SEQ ID NO: 33)<br>L-SETit.Cab3-1:1:1 (SEQ ID NO: 114) | GUS-2 | T-Os.LTP-1:1:1 |
| pMON127446 | P-SETit.PSI-4a-1:1:1 (SEQ ID NO: 86)<br>L-SETit.PSI-4a-1:1:1 (SEQ ID NO: 159) | GUS-2 | T-Os.LTP-1:1:1 |
| pMON127447 | P-SETit.Rbcs-1:1:1 (SEQ ID NO: 87)<br>L-SETit.Rbcs-1:1:1 (SEQ ID NO: 160) | GUS-2 | T-Os.LTP-1:1:1 |
| pMON127448 | P-SETit.Cab1-1:1:1 (SEQ ID NO: 32)<br>L-SETit.Cab1-1:1:1 (SEQ ID NO: 113) | GUS-2 | T-Os.LTP-1:1:1 |
| pMON127449 | P-SETit.Fba-1:1:1 (SEQ ID NO: 51)<br>L-SETit.Fba-1:1:1 (SEQ ID NO: 131) | GUS-2 | T-Os.LTP-1:1:1 |
| pMON132037 | EXP-SETit.Ubq1:1:1 (SEQ ID NO: 20)<br>P-SETit.Ubq1-1:1:1 (SEQ ID NO: 102)<br>L-SETit.Ubq1-1:1:1 (SEQ ID NO: 169)<br>I-SETit.Ubq1-1:1:1 (SEQ ID NO: 177) | GUS-2 | T-Os.LTP-1:1:1 |

The plant transformation vector, pMON109728 is comprised of the transcriptional regulatory element group, EXP-FMV.35S-SETit.Tip (SEQ ID NO: 8), which is further comprised of the enhancer element, E-FMV.35S-1:1:2 (SEQ ID NO: 351), operably linked 5' to the promoter element, P-SETit.Tip-1:1:1 (SEQ ID NO: 96), operably linked 5' to the leader element, L-SETit.Tip-1:1:1 (SEQ ID NO: 165). The plant transformation vector, pMON112215 is comprised of the promoter element, P-SETit.Rcc3-1:1:1 (SEQ ID NO: 88), operably linked 5' to the leader element, L-SETit.Rcc3-1:1:1 (SEQ ID NO: 161) The plant transformation vector, pMON116789 is comprised of the promoter element, P-SETit.Rcc3-1:1:11 (SEQ ID NO: 90), operably linked 5' to the leader element, L-SETit.Rcc3-1:1:2 (SEQ ID NO: 162). The plant transformation vector, pMON116816 is comprised of the promoter element, P-SETit.Rcc3-1:1:11 (SEQ ID NO: 90), operably linked 5' to the leader element, L-SETit.Rcc3-1:1:2 (SEQ ID NO: 162). The plant transformation vector, pMON116818 is comprised of the promoter element, P-SETit.Pox-1:1:1 (SEQ ID NO: 73), operably linked 5' to the leader element, L-SETit.Pox-1:1:1 (SEQ ID NO: 147). The plant transformation vector, pMON116820 is comprised of the promoter element, P-SETit.Gst-1:1:1 (SEQ ID NO: 58), operably linked 5' to the leader element, L-SETit.Gst-1:1:1 (SEQ ID NO: 135). The plant transformation vector, pMON116829 is comprised of the promoter element, P-SETit.Rcc3-1:1:10 (SEQ ID NO: 89), operably linked 5' to the leader element, L-SETit.Rcc3-1:1:2 (SEQ ID NO: 162). The plant transformation vector, pMON120698 is comprised of the transcriptional regulatory element group, EXP-FMV.35S-SETit.Rcc3:a (SEQ ID NO: 6), which is further comprised of the enhancer element, E-FMV.35S-1:1:2 (SEQ ID NO: 351), operably linked 5' to the promoter element, P-SETit.Rcc3-1:1:10 (SEQ ID NO: 89), operably linked 5' to the leader element, L-SETit.Rcc3-1:1:2 (SEQ ID NO: 162). The plant transformation vector, pMON120699 is comprised of the transcriptional regulatory element group, EXP-FMV.35S-SETit.Gst:a (SEQ ID NO: 2), which is further comprised of the enhancer element, E-FMV.35S-1:1:2 (SEQ ID NO: 351), operably linked 5' to the promoter element, P-SETit.Gst-1:1:1 (SEQ ID NO: 58), operably linked 5' to the leader element, L-SETit.Gst-1:1:1 (SEQ ID NO: 135). The plant transformation vector, pMON120700 is comprised of the transcriptional regulatory element group, EXP-FMV.35S-SETit.Rcc3:b (SEQ ID NO: 7), which is further comprised of the enhancer element, E-FMV.35S-1:1:2 (SEQ ID NO: 351), operably linked 5' to the promoter element, P-SETit.Rcc3-1:1:11 (SEQ ID NO: 90), operably linked 5' to the leader element, L-SETit.Rcc3-1:1:2 (SEQ ID NO: 162). The plant transformation vector, pMON120701 is comprised of the transcriptional regulatory element group, EXP-FMV.35S-SETit.Pox (SEQ ID NO: 5), which is further comprised of the enhancer element, E-FMV.35S-1:1:2 (SEQ ID NO: 351), operably linked 5' to the promoter element, P-SETit.Pox-1:1:1 (SEQ ID NO: 73), operably linked 5' to the leader element, L-SETit.Pox-1:1:1 (SEQ ID NO: 147). The plant transformation vector, pMON120702 is comprised of the promoter element, P-SETit.Ccoamt-1:1:2 (SEQ ID NO: 35), operably linked 5' to the leader element, L-SETit.Ccoamt-1:1:2 (SEQ ID NO: 116). The plant transformation vector, pMON120703 is comprised of the transcriptional regulatory element group, EXP-FMV.35S-SETit.Ccoamt (SEQ ID NO: 1), which is further comprised of the enhancer element, E-FMV.35S-1:1:2 (SEQ ID NO: 351), operably linked 5' to the promoter element, P-SETit.Ccoamt-1:1:2 (SEQ ID NO: 35), operably linked 5' to the leader element, L-SETit.Ccoamt-1:1:2 (SEQ ID NO: 116). The plant transformation vector, pMON120704 is comprised of the promoter element, P-SETit.Gst-1:1:2 (SEQ ID NO: 59), operably linked 5' to the leader element, L-SETit.Gst-1:1:1 (SEQ ID NO: 135). The plant transformation vector, pMON120705 is comprised of the transcriptional regulatory element group, EXP-FMV.35S-SETit.Gst:b (SEQ ID NO: 3), which is further comprised of the enhancer element, E-FMV.35S-1:1:2 (SEQ ID NO: 351), operably linked 5' to the promoter element, P-SETit.Gst-1:1:2 (SEQ ID NO: 59), operably linked 5' to the leader element, L-SETit.Gst-1:1:1 (SEQ ID NO: 135). The plant transformation vector, pMON120706 is comprised of the transcriptional regulatory element group, EXP-FMV.35S-SETit.Ifr (SEQ ID NO: 4), which is further comprised of the enhancer element, E-FMV.35S-1:1:2 (SEQ ID NO: 351), operably linked 5' to the promoter element, P-SETit.Ifr-1:1:3 (SEQ ID NO: 61), operably linked 5' to the leader element, L-SETit.Ifr-1:1:1 (SEQ ID NO: 136). The plant transformation vector, pMON120709 is comprised of the promoter element, P-SETit.Nrt2-1:1:3 (SEQ ID NO: 65), operably linked 5' to the leader element, L-SETit.Nrt2-1:1:2 (SEQ ID NO: 139). The plant transformation vector, pMON120710 is comprised of the promoter element, P-SETit.Nrt2-1:1:2 (SEQ ID NO: 64), operably linked 5' to the leader element, L-SETit.Nrt2-1:1:2 (SEQ ID NO: 139). The plant transformation vector, pMON120711 is comprised of the promoter element, P-SETit.Pip2-1:1:3 (SEQ ID NO: 71), operably linked 5' to the leader element, L-SETit.Pip2-1:1:1 (SEQ ID NO: 145). The plant transformation vector, pMON120712 is comprised of the promoter element, P-SETit.Ifr-1:1:2 (SEQ ID NO: 60), operably linked 5' to the leader element, L-SETit.Ifr-1:1:1 (SEQ ID NO: 136). The plant transformation vector, pMON120713 is comprised of the promoter element, P-SETit.Ifr-1:1:3 (SEQ ID NO: 61), operably linked 5' to the leader element, L-SETit.Ifr-1:1:1 (SEQ ID NO: 136). The plant transformation vector, pMON127440 is comprised of the promoter element, P-SETit.Ppc-1:1:3 (SEQ ID NO: 74), operably linked 5' to the leader element, L-SETit.Ppc-1:1:1 (SEQ ID NO: 148). The plant transformation vector, pMON127441 is comprised of the promoter element, P-SETit.Ppc-1:1:4 (SEQ ID NO: 75), operably linked 5' to the leader element, L-SETit.Ppc-1:1:1 (SEQ ID NO: 148) The plant transformation vector, pMON127442 is comprised of the promoter element, P-SETit.Gapdh2-1:1:3 (SEQ ID NO: 55), operably linked 5' to the leader element, L-SETit.Gapdh2-1:1:1 (SEQ ID NO: 133). The plant transformation vector, pMON127443 is comprised of the transcriptional regulatory element group, EXP-SETit.Ppdk:1:1 (SEQ ID NO: 14), promoter element, P-SETit.Ppdk-1:1:1 (SEQ ID NO: 76), operably linked 5' to the leader element, L-SETit.Ppdk-1:1:4 (SEQ ID NO: 150), operably linked 5' to the intron element, I-SETit.Ppdk-1:1:1 (SEQ ID NO: 175), operably linked 5' to the leader element, L-SETit.Ppdk-1:1:2 (SEQ ID NO: 149). The plant transformation vector, pMON127444 is comprised of the promoter element, P-SETit.CP29-1:1:4 (SEQ ID NO: 42), operably linked 5' to the leader element, L-SETit.CP29-1:1:1 (SEQ ID NO: 124). The plant transformation vector, pMON127445 promoter element, P-SETit.Cab3-1:1:3 (SEQ ID NO: 33), operably linked 5' to the leader element, L-SETit.Cab3-1:1:1 (SEQ ID NO: 114). The plant transformation vector, pMON127446 is comprised of the promoter element, P-SETit.PSI-4a-1:1:1 (SEQ ID NO: 86), operably linked 5' to the leader element, L-SETit.PSI-4a-1:1:1 (SEQ ID NO: 159). The plant transformation vector, pMON127447 is comprised of the promoter element, P-SETit.Rbcs-1:1:1 (SEQ ID NO: 87), operably linked 5' to the leader element, L-SETit.Rbcs-1:1:1 (SEQ ID NO: 160). The plant transformation vector, pMON127448 is comprised of the promoter element, P-SETit.Cab1-1:1:1 (SEQ ID NO: 32), operably linked 5' to the leader element, L-SETit.Cab1-1:1:1 (SEQ ID NO: 113). The plant transformation vector, pMON127449 is comprised of the promoter element, P-SETit.Fba-1:1:1 (SEQ ID NO: 51), operably linked 5' to the leader element, L-SETit.Fba-1:1:1 (SEQ ID NO: 131). The plant transformation vector, pMON132037 is comprised of the transcriptional regulatory element group, EXP-SETit.Ubq1:1:1 (SEQ ID NO: 20), which is further comprised of the promoter element, P-SETit.Ubq1-1:1:1 (SEQ ID NO: 102), operably linked 5' to the leader element, L-SETit.Ubq1-1:1:1 (SEQ ID NO: 169), operably linked 5' to the intron element, I-SETit.Ubq1-1:1:1 (SEQ ID NO: 177).

Corn plants were transformed with plant GUS expression constructs, pMON109728, pMON112215, pMON116789, pMON116816, pMON116818, pMON116820, pMON116829, pMON120698, pMON120699, pMON120700, pMON120701, pMON120702, pMON120703, pMON120704, pMON120705, pMON120706, pMON120709, pMON120710, pMON120711, pMON120712, pMON120713, pMON127440, pMON127441, pMON127442, pMON127443, pMON127444, pMON127445, pMON127446, pMON127447, pMON127448, pMON127449 and pMON132037.

Plants were transformed using *Agrobacterium*-mediated transformations known to those skilled in the art. Briefly, LH244 corn seed embryos are extracted from surface-sterilized, developing corn kernels approximately 9 to 13 days after pollination. The embryos are co-cultured with *Agrobacterium tumefaciens*, transformed with the GUS expression constructs for 18 to 28 hours in the dark. The embryos are then transferred to selective media and cultured in the dark for approximately 3 weeks to induce the formation of callus. Following callus induction, the embryo-derived callus tissue is transferred to new media and cultured under light for 5 to 10 days. The callus tissue is then transferred to new media to induce the formation of shoots. After 2 to 3 weeks, the transformed shoots are transferred to rooting medium and cultured to permit the formation of roots. Once sufficient root formation has occurred, the transformed plants are transferred to soil and transferred to the greenhouse. Events containing one or two copies of the transgene cassette are selected for study using real-time PCR methods known to those skilled in the art.

Histochemical GUS analysis was used for qualitative expression analysis of transformed plants. Whole tissue sections were incubated with GUS staining solution X-Gluc (5-bromo-4-chloro-3-indolyl-b-glucuronide) (1 milligram/ milliliter) for an appropriate length of time, rinsed, and visually inspected for blue coloration. GUS activity was qualitatively determined by direct visual inspection or inspection under a microscope using selected plant organs and tissues. The R0 plants were inspected for expression in the roots and leaves.

For quantitative analysis, total protein was extracted from selected tissues of transformed corn plants. One microgram of total protein was used with the fluorogenic substrate 4-methyleumbelliferyl-β-D-glucuronide (MUG) in a total reaction volume of 50 microliters. The reaction product, 4-methlyumbelliferone (4-MU), is maximally fluorescent at high pH, where the hydroxyl group is ionized. Addition of a basic solution of sodium carbonate simultaneously stops the assay and adjusts the pH for quantifying the fluorescent product. Fluorescence was measured with excitation at 365 nm, emission at 445 nm using a Fluoromax-3 with Micromax Reader, with slit width set at excitation 2 nm and emission 3 nm.

The average $R_0$ GUS expression observed for each transformation is presented in Table 3 and 4 below.

TABLE 3

Average $R_0$ GUS Leaf and Root expression in transgenic corn plants, transformed with listed construct.

| Construct | Regulatory Elements | V3 Root | V7 Root | VT Root | V3 Leaf | V7 Leaf | VT Leaf |
|---|---|---|---|---|---|---|---|
| pMON109728 | EXP-FMV.35S-SETit.Tip (SEQ ID NO: 8) E-FMV.35S-1:1:2 (SEQ ID NO: 177) P-SETit.Tip-1:1:1 (SEQ ID NO: 95) L-SETit.Tip-1:1:1 (SEQ ID NO: 163) | 11.98 | nd | 14.78 | 423.85 | nd | 11.38 |
| pMON112215 | P-SETit.Rcc3-1:1:1 (SEQ ID NO: 88) L-SETit.Rcc3-1:1:1 (SEQ ID NO: 161) | nd | nd | nd | nd | nd | nd |
| pMON116789 | P-SETit.Rcc3-1:1:11 (SEQ ID NO: 90) L-SETit.Rcc3-1:1:2 (SEQ ID NO: 162) | 43.43 | nd | 363.90 | 19.09 | 12.16 | 6.58 |
| pMON116816 | P-SETit.Rcc3-1:1:11 (SEQ ID NO: 90) L-SETit.Rcc3-1:1:2 (SEQ ID NO: 162) | 5.77 | nd | 0.00 | 35.02 | nd | 0.00 |
| pMON116818 | P-SETit.Pox-1:1:1 (SEQ ID NO: 73) L-SETit.Pox-1:1:1 (SEQ ID NO: 147) | 8.10 | nd | 0.00 | 22.96 | 0.00 | 0.00 |
| pMON116820 | P-SETit.Gst-1:1:1 (SEQ ID NO: 58) L-SETit.Gst-1:1:1 (SEQ ID NO: 135) | 0.00 | nd | 12.06 | 5.21 | 0.00 | 8.85 |
| PMON116829 | P-SETit.Rcc3-1:1:10 (SEQ ID NO: 89) L-SETit.Rcc3-1:1:2 (SEQ ID NO: 162) | 20.67 | nd | 0.00 | 0.00 | 0.00 | 0.00 |
| pMON120698 | EXP-FMV.35S-SETit.Rcc3:a (SEQ ID NO: 6) E-FMV.35S-1:1:2 (SEQ ID NO: 351) P-SETit.Rcc3-1:1:10 (SEQ ID NO: 89) L-SETit.Rcc3-1:1:2 (SEQ ID NO: 162) | 0.00 | nd | 12.90 | 0.00 | 0.00 | 0.00 |
| pMON120699 | EXP-FMV.35S-SETit.Gst:a (SEQ ID NO: 2) E-FMV.355-1:1:2 (SEQ ID NO: 351) P-SETit.Gst-1:1:1 (SEQ ID NO: 58) L-SETit.Gst-1:1:1 (SEQ ID NO: 135) | 19.42 | nd | 147.75 | 47.82 | 26.76 | 116.51 |
| pMON120700 | EXP-FMV.35S-SETit.Rcc3:b (SEQ ID NO: 7) | nd | 11.97 | 12.18 | 0.00 | 5.16 | 0.00 |

TABLE 3-continued

Average R₀ GUS Leaf and Root expression in transgenic corn plants, transformed with listed construct.

| Construct | Regulatory Elements | V3 Root | V7 Root | VT Root | V3 Leaf | V7 Leaf | VT Leaf |
|---|---|---|---|---|---|---|---|
| | E-FMV.35S-1:1:2 (SEQ ID NO: 351) P-SETit.Rcc3-1:1:11 (SEQ ID NO: 90) L-SETit.Rcc3-1:1:2 (SEQ ID NO: 162) | | | | | | |
| pMON120701 | EXP-FMV.35S-SETit.Pox (SEQ ID NO: 5) E-FMV.35S-1:1:2 (SEQ ID NO: 351) P-SETit.Pox-1:1:1 (SEQ ID NO: 73) L-SETit.Pox-1:1:1 (SEQ ID NO: 147) | 10.42 | 35.53 | 22.82 | 0.00 | 0.00 | 0.00 |
| pMON120702 | P-SETit.Ccoamt-1:1:2 (SEQ ID NO: 35) L-SETit.Ccoamt-1:1:2 (SEQ ID NO: 116) | 0.00 | nd | 14.98 | 0.00 | 0.00 | 8.81 |
| pMON120703 | EXP-FMV.35S-SETit.Ccoamt (SEQ ID NO: 1) E-FMV.35S-1:1:2 (SEQ ID NO: 351) P-SETit.Ccoamt-1:1:2 (SEQ ID NO: 35) L-SETit.Ccoamt-1:1:2 (SEQ ID NO: 116) | 9.79 | nd | 93.87 | 12.14 | 67.80 | 22.52 |
| pMON120704 | P-SETit.Gst-1:1:2 (SEQ ID NO: 59) L-SETit.Gst-1:1:1 (SEQ ID NO: 135) | 7.12 | nd | 24.05 | 0.00 | 8.78 | 0.00 |
| pMON120705 | EXP-FMV.35S-SETit.Gst:b (SEQ ID NO: 3) E-FMV.35S-1:1:2 (SEQ ID NO: 351) P-SETit.Gst-1:1:2 (SEQ ID NO: 59) L-SETit.Gst-1:1:1 (SEQ ID NO: 135) | 19.48 | nd | 38.27 | 34.28 | 136.79 | 104.30 |
| pMON120706 | EXP-FMV.35S-SETit.Ifr (SEQ ID NO: 4) E-FMV.35S-1:1:2 (SEQ ID NO: 351) P-SETit.Ifr-1:1:3 (SEQ ID NO: 61) L-SETit.Ifr-1:1:1 (SEQ ID NO: 136) | 25.62 | nd | 92.11 | 32.18 | 191.22 | 107.41 |
| pMON120709 | P-SETit.Nrt2-1:1:3 (SEQ ID NO: 65) L-SETit.Nrt2-1:1:2 (SEQ ID NO: 139) | 10.40 | nd | 7.20 | 0.00 | 0.00 | 0.00 |
| pMON120710 | P-SETit.Nrt2-1:1:2 (SEQ ID NO: 64) | 17.29 | nd | 11.89 | 0.00 | 0.00 | 0.00 |

TABLE 3-continued

Average R₀ GUS Leaf and Root expression in transgenic corn plants, transformed with listed construct.

| Construct | Regulatory Elements | V3 Root | V7 Root | VT Root | V3 Leaf | V7 Leaf | VT Leaf |
|---|---|---|---|---|---|---|---|
| | L-SETit.Nrt2-1:1:2 (SEQ ID NO: 139) | | | | | | |
| pMON120711 | P-SETit.Pip2-1:1:3 (SEQ ID NO: 71) | 168.44 | 36.18 | 14.61 | 22.48 | 0.00 | 7.04 |
| | L-SETit.Pip2-1:1:1 (SEQ ID NO: 145) | | | | | | |
| pMON120712 | P-SETit.Ifr-1:1:2 (SEQ ID NO: 60) | 64.92 | nd | 15.97 | 0.00 | 0.00 | 0.00 |
| | L-SETit.Ifr-1:1:1 (SEQ ID NO: 136) | | | | | | |
| pMON120713 | P-SETit.Ifr-1:1:3 (SEQ ID NO: 61) | 0.00 | nd | 0.00 | 0.00 | 0.00 | 6.38 |
| | L-SETit.Ifr-1:1:1 (SEQ ID NO: 136) | | | | | | |
| pMON127440 | P-SETit.Ppc-1:1:3 (SEQ ID NO: 74) | 0.00 | nd | 0.47 | 0.00 | 0.00 | 37.59 |
| | L-SETit.Ppc-1:1:1 (SEQ ID NO: 148) | | | | | | |
| pMON127441 | P-SETit.Ppc-1:1:4 (SEQ ID NO: 75) | 0.00 | 0.00 | 0.00 | 101.10 | 521.14 | 179.12 |
| | L-SETit.Ppc-1:1:1 (SEQ ID NO: 148) | | | | | | |
| pMON127442 | P-SETit.Gapdh2-1:1:3 (SEQ ID NO: 55) | 0.00 | 0.00 | 0.00 | 13.12 | 0.00 | 0.00 |
| | L-SETit.Gapdh2-1:1:1 (SEQ ID NO: 133) | | | | | | |
| pMON127443 | EXP-SETit.Ppdk:1:1 (SEQ ID NO: 14) P-SETit.Ppdk-1:1:1 (SEQ ID NO: 76) L-SETit.Ppdk-1:1:4 (SEQ ID NO: 150) I-SETit.Ppdk-1:1:1 (SEQ ID NO: 175) L-SETit.Ppdk-1:1:2 (SEQ ID NO: 149) | 0.00 | 0.00 | 5.66 | 32.56 | 21.04 | 58.48 |
| pMON127444 | P-SETit.CP29-1:1:4 (SEQ ID NO: 42) | 0.00 | 6.17 | 0.00 | 165.74 | 348.96 | 249.42 |
| | L-SETit.CP29-1:1:1 (SEQ ID NO: 124) | | | | | | |
| pMON127445 | P-SETit.Cab3-1:1:3 (SEQ ID N0:33) | <0.1 | <0.1 | <0.1 | 299.16 | 136.85 | 179.80 |
| | L-SETit.Cab3-1:1:1 (SEQ ID NO: 114) | | | | | | |
| pMON127446 | P-SETit.PSI-4a-1:1:1 (SEQ ID NO: 86) | 0.00 | 0.00 | 0.00 | 101.30 | 83.44 | 110.81 |
| | L-SETit.PSI-4a-1:1:1 (SEQ ID NO: 159) | | | | | | |
| pMON127447 | P-SETit.Rbcs-1:1:1 (SEQ ID NO: 87) | 0.00 | 22.74 | 18.69 | 160.14 | 172.65 | 264.89 |
| | L-SETit.Rbcs-1:1:1 (SEQ ID NO: 160) | | | | | | |

TABLE 3-continued

Average R₀ GUS Leaf and Root expression in transgenic corn plants, transformed with listed construct.

| Construct | Regulatory Elements | V3 Root | V7 Root | VT Root | V3 Leaf | V7 Leaf | VT Leaf |
|---|---|---|---|---|---|---|---|
| pMON127448 | P-SETit.Cab1-1:1:1 (SEQ ID NO: 32) L-SETit.Cab1-1:1:1 (SEQ ID NO: 113) | 0.16 | 0.00 | 0.00 | 158.08 | 109.59 | 48.01 |
| pMON127449 | P-SETit.Fba-1:1:1 (SEQ ID NO: 51) L-SETit.Fba-1:1:1 (SEQ ID NO: 131) | <0.1 | <0.1 | <0.1 | 81.41 | 82.57 | 83.95 |
| pMON132037 | EXP-SETit.Ubq1:1:1 (SEQ ID NO: 20) P-SETit.Ubq1-1:1:1 (SEQ ID NO: 102) L-SETit.Ubq1-1:1:1 (SEQ ID NO: 169) I-SETit.Ubq1-1:1:1 (SEQ ID NO: 177) | 0.00 | 28.54 | 57.31 | 57.95 | 36.71 | 45.62 |

The average level of GUS expression amongst the constructs varied. Those constructs demonstrating the highest level of root expression, particularly at VT stage were: pMON116789 ((P-SETit.Rcc3-1:1:11 (SEQ ID NO: 90)+L-SETit.Rcc3-1:1:2 (SEQ ID NO: 162)); pMON120699 ((EXP-FMV.35S-SETit.Gst:a (SEQ ID NO: 2), comprised of E-FMV.35S-1:1:2 (SEQ ID NO: 179)+P-SETit.Gst-1:1:1 (SEQ ID NO: 58)+L-SETit.Gst-1:1:1 (SEQ ID NO: 135)); pMON120703 ((EXP-FMV.35S-SETit.Ccoamt (SEQ ID NO: 1), comprised of E-FMV.35S-1:1:2 (SEQ ID NO: 179)+P-SETit.Ccoamt-1:1:2 (SEQ ID NO: 35)+L-SETit.Ccoamt-1:1:2 (SEQ ID NO: 116)); pMON120706 ((EXP-FMV.35S-SETit.Ifr (SEQ ID NO: 4) comprised of E-FMV.35S-1:1:2 (SEQ ID NO: 179)+P-SETit.Ifr-1:1:3 (SEQ ID NO: 61)+L-SETit.Ifr-1:1:1 (SEQ ID NO: 136)) and pMON132037 ((EXP-SETit.Ubq1:1:1 (SEQ ID NO: 20) comprised of P-SETit.Ubq1-1:1:1 (SEQ ID NO: 102)+L-SETit.Ubq1-1:1:1 (SEQ ID NO: 169)+I-SETit.Ubq1-1:1:1 (SEQ ID NO: 177)).

Those constructs demonstrating the highest level of leaf expression were: pMON127447 ((P-SETit.Rbcs-1:1:1 (SEQ ID NO: 87)+L-SETit.Rbcs-1:1:1 (SEQ ID NO: 160)); pMON127444 ((P-SETit.CP29-1:1:4 (SEQ ID NO: 42)+L-SETit.CP29-1:1:1 (SEQ ID NO: 124)); pMON127445 ((P-SETit.Cab3-1:1:3 (SEQ ID NO: 33)+L-SETit.Cab3-1:1:1 (SEQ ID NO: 114)); pMON127441 ((P-SETit.Ppc-1:1:4 (SEQ ID NO: 75)+L-SETit.Ppc-1:1:1 (SEQ ID NO: 148)); pMON120699 ((EXP-FMV.35S-SETit.Gst:a (SEQ ID NO: 2) comprised of E-FMV.35S-1:1:2 (SEQ ID NO: 179)+P-SETit.Gst-1:1:1 (SEQ ID NO: 58)+L-SETit.Gst-1:1:1 (SEQ ID NO: 135)); pMON127446 ((P-SETit.PSI-4a-1:1:1 (SEQ ID NO: 86)+L-SETit.PSI-4a-1:1:1 (SEQ ID NO: 159)); pMON120706 ((EXP-FMV.35S-SETit.Ifr (SEQ ID NO: 4) comprised of E-FMV.35S-1:1:2 (SEQ ID NO: 179)+P-SETit.Ifr-1:1:3 (SEQ ID NO: 61)+L-SETit.Ifr-1:1:1 (SEQ ID NO: 136)); pMON120705 ((EXP-FMV.35S-SETit.Gst:b (SEQ ID NO: 3) comprised of E-FMV.35S-1:1:2 (SEQ ID NO: 179)+P-SETit.Gst-1:1:2 (SEQ ID NO: 59)+L-SETit.Gst-1:1:1 (SEQ ID NO: 135)) and pMON127449 ((P-SETit.Fba-1:1:1 (SEQ ID NO: 51)+L-SETit.Fba-1:1:1 (SEQ ID NO: 131)).

TABLE 4

Average R₀ GUS Anther, Silk, Endosperm and Embryo expression in transgenic corn plants, transformed with listed construct.

| Construct | Regulatory Elements | VT Anther | VT Silk | 21 DAP Embryo | 21 DAP Endosperm |
|---|---|---|---|---|---|
| pMON109728 | EXP-FMV.35S-SETit.Tip (SEQ ID NO: 8) E-FMV.35S-1:1:2 (SEQ ID NO: 177) P-SETit.Tip-1:1:1 (SEQ ID NO: 95) L-SETit.Tip-1:1:1 (SEQ ID NO: 163) | nd | 74.07 | nd | nd |
| pMON112215 | P-SETit.Rcc3-1:1:1 (SEQ ID NO: 88) L-SETit.Rcc3-1:1:1 (SEQ ID NO: 161) | nd | nd | nd | nd |
| pMON116789 | P-SETit.Rcc3-1:1:11 (SEQ ID NO: 90) | 289.88 | 11.83 | nd | nd |

TABLE 4-continued

Average R₀ GUS Anther, Silk, Endosperm and Embryo expression in transgenic corn plants, transformed with listed construct.

| Construct | Regulatory Elements | VT Anther | VT Silk | 21 DAP Embryo | 21 DAP Endosperm |
|---|---|---|---|---|---|
| | L-SETit.Rcc3-1:1:2 (SEQ ID NO: 162) | | | | |
| pMON116816 | P-SETit.Rcc3-1:1:11 (SEQ ID NO: 90) | 9.66 | 0.00 | 17.06 | 20.16 |
| | L-SETit.Rcc3-1:1:2 (SEQ ID NO: 162) | | | | |
| pMON116818 | P-SETit.Pox-1:1:1 (SEQ ID NO: 73) | 0.00 | 10.12 | 0.00 | 0.00 |
| | L-SETit.Pox-1:1:1 (SEQ ID NO: 147) | | | | |
| pMON116820 | P-SETit.Gst-1:1:1 (SEQ ID NO: 58) | 19.62 | 8.08 | 14.09 | 15.25 |
| | L-SETit.Gst-1:1:1 (SEQ ID NO: 135) | | | | |
| PM0N116829 | P-SETit.Rcc3-1:1:10 (SEQ ID NO: 89) | 8.58 | 0.00 | 0.00 | 12.52 |
| | L-SETit.Rcc3-1:1:2 (SEQ ID NO: 162) | | | | |
| pMON120698 | EXP-FMV.35S-SETit.Rcc3:a (SEQ ID NO: 6) | 0.00 | 0.00 | 13.62 | 23.07 |
| | E-FMV.35S-1:1:2 (SEQ ID NO: 351) | | | | |
| | P-SETit.Rcc3-1:1:10 (SEQ ID NO: 89) | | | | |
| | L-SETit.Rcc3-1:1:2 (SEQ ID NO: 162) | | | | |
| pMON120699 | EXP-FMV.35S-SETit.Gst:a (SEQ ID NO: 2) | 41.63 | 21.74 | 27.03 | 92.79 |
| | E-FMV.35S-1:1:2 (SEQ ID NO: 351) | | | | |
| | P-SETit.Gst-1:1:1 (SEQ ID NO: 58) | | | | |
| | L-SETit.Gst-1:1:1 (SEQ ID NO: 135) | | | | |
| pMON120700 | EXP-FMV.35S-SETit.Rcc3:b (SEQ ID NO: 7) | 7.65 | 0.00 | 0.00 | 11.30 |
| | E-FMV.35S-1:1:2 (SEQ ID NO: 351) | | | | |
| | P-SETit.Rcc3-1:1:11 (SEQ ID NO: 90) | | | | |
| | L-SETit.Rcc3-1:1:2 (SEQ ID NO: 162) | | | | |
| pMON120701 | EXP-FMV.35S-SETit.Pox (SEQ ID NO: 5) | 55.20 | 77.97 | 0.00 | 10.70 |
| | E-FMV.35S-1:1:2 (SEQ ID NO: 351) | | | | |
| | P-SETit.Pox-1:1:1 (SEQ ID NO: 73) | | | | |
| | L-SETit.Pox-1:1:1 (SEQ ID NO: 147) | | | | |
| pMON120702 | P-SETit.Ccoamt-1:1:2 (SEQ ID NO: 35) | 33.96 | 0.00 | 0.00 | 6.93 |
| | L-SETit.Ccoamt-1:1:2 (SEQ ID NO: 116) | | | | |
| pMON120703 | EXP-FMV.35S-SETit.Ccoamt (SEQ ID NO: 1) | 22.01 | 36.65 | 9.23 | 28.99 |
| | E-FMV.35S-1:1:2 (SEQ ID NO: 351) | | | | |
| | P-SETit.Ccoamt-1:1:2 (SEQ ID NO: 35) | | | | |
| | L-SETit.Ccoamt-1:1:2 (SEQ ID NO: 116) | | | | |
| pMON120704 | P-SETit.Gst-1:1:2 (SEQ ID NO: 59) | 16.43 | 0.00 | nd | nd |
| | L-SETit.Gst-1:1:1 (SEQ ID NO: 135) | | | | |
| pMON120705 | EXP-FMV.35S-SETit.Gst:b (SEQ ID NO: 3) | 156.37 | 46.06 | 39.48 | 82.83 |
| | E-FMV.35S-1:1:2 (SEQ ID NO: 351) | | | | |
| | P-SETit.Gst-1:1:2 (SEQ ID NO: 59) | | | | |
| | L-SETit.Gst-1:1:1 (SEQ ID NO: 135) | | | | |

TABLE 4-continued

Average R₀ GUS Anther, Silk, Endosperm and Embryo expression in transgenic corn plants, transformed with listed construct.

| Construct | Regulatory Elements | VT Anther | VT Silk | 21 DAP Embryo | 21 DAP Endosperm |
|---|---|---|---|---|---|
| pMON120706 | EXP-FMV.35S-SETit.Ifr (SEQ ID NO: 4) E-FMV.35S-1:1:2 (SEQ ID NO: 351) P-SETit.Ifr-1:1:3 (SEQ ID NO: 61) L-SETit.Ifr-1:1:1 (SEQ ID NO: 136) | 77.35 | 307.35 | 14.27 | 100.43 |
| pMON120709 | P-SETit.Nrt2-1:1:3 (SEQ ID NO: 65) L-SETit.Nrt2-1:1:2 (SEQ ID NO: 139) | 6.90 | 132.25 | 138.75 | 20.39 |
| pMON120710 | P-SETit.Nrt2-1:1:2 (SEQ ID NO: 64) L-SETit.Nrt2-1:1:2 (SEQ ID NO: 139) | 8.60 | 0.00 | 12.49 | 6.52 |
| pMON120711 | P-SETit.Pip2-1:1:3 (SEQ ID NO: 71) L-SETit.Pip2-1:1:1 (SEQ ID NO: 145) | 15.13 | 6.65 | 10.49 | 0.00 |
| pMON120712 | P-SETit.Ifr-1:1:2 (SEQ ID NO: 60) L-SETit.Ifr-1:1:1 (SEQ ID NO: 136) | 9.64 | 0.00 | 8.26 | 0.00 |
| pMON120713 | P-SETit.Ifr-1:1:3 (SEQ ID NO: 61) L-SETit.Ifr-1:1:1 (SEQ ID NO: 136) | 11.02 | 0.00 | 23.91 | 5.94 |
| pMON127440 | P-SETit.Ppc-1:1:3 (SEQ ID NO: 74) L-SETit.Ppc-1:1:1 (SEQ ID NO: 148) | 18.44 | 1.15 | 0.00 | 0.00 |
| pMON127441 | P-SETit.Ppc-1:1:4 (SEQ ID NO: 75) L-SETit.Ppc-1:1:1 (SEQ ID NO: 148) | 181.79 | 0.00 | 4.10 | 1.17 |
| pMON127442 | P-SETit.Gapdh2-1:1:3 (SEQ ID NO: 55) L-SETit.Gapdh2-1:1:1 (SEQ ID NO: 133) | 28.05 | 0.00 | 155.68 | 400.86 |
| pMON127443 | EXP-SETit.Ppdk:1:1 (SEQ ID NO: 14) P-SETit.Ppdk-1:1:1 (SEQ ID NO: 76) L-SETit.Ppdk-1:1:4 (SEQ ID NO: 150) I-SETit.Ppdk-1:1:1 (SEQ ID NO: 175) L-SETit.Ppdk-1:1:2 (SEQ ID NO: 149) | 0.00 | 0.00 | 2.62 | 0.67 |
| pMON127444 | P-SETit.CP29-1:1:4 (SEQ ID NO: 42) L-SETit.CP29-1:1:1 (SEQ ID NO: 124) | 87.67 | 24.63 | 0.00 | 0.00 |
| pMON127445 | P-SETit.Cab3-1:1:3 (SEQ ID NO: 33) L-SETit.Cab3-1:1:1 (SEQ ID NO: 114) | 35.79 | 35.94 | <0.1 | <0.1 |
| pMON127446 | P-SETit.PSI-4a-1:1:1 (SEQ ID NO: 86) L-SETit.PSI-4a-1:1:1 (SEQ ID NO: 159) | 56.44 | 194.45 | 1.64 | 3.24 |
| pMON127447 | P-SETit.Rbcs-1:1:1 (SEQ ID NO: 87) L-SETit.Rbcs-1:1:1 (SEQ ID NO: 160) | 102.30 | 125.45 | 3.25 | 6.58 |
| pMON127448 | P-SETit.Cab1-1:1:1 (SEQ ID NO: 32) L-SETit.Cab1-1:1:1 (SEQ ID NO: 113) | 61.33 | 22.61 | 2.32 | 4.47 |
| pMON127449 | P-SETit.Fba-1:1:1 (SEQ ID NO: 51) L-SETit.Fba-1:1:1 (SEQ ID NO: 131) | 12.62 | <0.1 | <0.1 | <0.1 |

TABLE 4-continued

Average R₀ GUS Anther, Silk, Endosperm and Embryo expression in transgenic corn plants, transformed with listed construct.

| Construct | Regulatory Elements | VT Anther | VT Silk | 21 DAP Embryo | 21 DAP Endosperm |
|---|---|---|---|---|---|
| pMON132037 | EXP-SETit.Ubq1:1:1 (SEQ ID NO: 20) P-SETit.Ubq1-1:1:1 (SEQ ID NO: 102) L-SETit.Ubq1-1:1:1 (SEQ ID NO: 169) I-SETit.Ubq1-1: 1: 1 (SEQ ID NO: 177) | 131.65 | 85.35 | 59.09 | 67.31 |

The average level of GUS expression in the seed and reproductive tissues varied amongst the constructs. Highest levels of anther expression at VT stage were observed for pMON116789 ((P-SETit.Rcc3-1:1:11 (SEQ ID NO: 90)+L-SETit.Rcc3-1:1:2 (SEQ ID NO: 162)); pMON127441 ((P-SETit.Ppc-1:1:4 (SEQ ID NO: 75)+L-SETit.Ppc-1:1:1 (SEQ ID NO: 148)); pMON120705 ((EXP-FMV.35S-SETit.Gst:b (SEQ ID NO: 3) comprised of E-FMV.35S-1:1:2 (SEQ ID NO: 179)+P-SETit.Gst-1:1:2 (SEQ ID NO: 59)+L-SETit.Gst-1:1:1 (SEQ ID NO: 135)); pMON132037 ((EXP-SETit.Ubq1:1:1 (SEQ ID NO: 20) comprised of P-SETit.Ubq1-1:1:1 (SEQ ID NO: 102)+L-SETit.Ubq1-1:1:1 (SEQ ID NO: 169)+I-SETit.Ubq1-1:1:1 (SEQ ID NO: 177)); pMON127447 ((P-SETit.Rbcs-1:1:1 (SEQ ID NO: 87)+L-SETit.Rbcs-1:1:1 (SEQ ID NO: 160)); pMON127444 ((P-SETit.CP29-1:1:4 (SEQ ID NO: 42)+L-SETit.CP29-1:1:1 (SEQ ID NO: 124)) and pMON120706 ((EXP-FMV.35S-SETit.Ifr (SEQ ID NO: 4) comprised of E-FMV.35S-1:1:2 (SEQ ID NO: 179)+P-SETit.Ifr-1:1:3 (SEQ ID NO: 61)+L-SETit.Ifr-1:1:1 (SEQ ID NO: 136)).

The highest levels of average GUS expression in the silk was observed in plants transformed with pMON120706 ((EXP-FMV.35S-SETit.Ifr (SEQ ID NO: 4) comprised of E-FMV.35S-1:1:2 (SEQ ID NO: 179)+P-SETit.Ifr-1:1:3 (SEQ ID NO: 61)+L-SETit.Ifr-1:1:1 (SEQ ID NO: 136)); pMON127446 ((P-SETit.PSI-4a-1:1:1 (SEQ ID NO: 86)+L-SETit.PSI-4a-1:1:1 (SEQ ID NO: 159)); pMON120709 ((P-SETit.Nrt2-1:1:3 (SEQ ID NO: 65)+L-SETit.Nrt2-1:1:2 (SEQ ID NO: 139)); pMON127447 ((P-SETit.Rbcs-1:1:1 (SEQ ID NO: 87)+L-SETit.Rbcs-1:1:1 (SEQ ID NO: 160)) and pMON132037 ((EXP-SETit.Ubq1:1:1 (SEQ ID NO: 20) comprised of P-SETit.Ubq1-1:1:1 (SEQ ID NO: 102)+L-SETit.Ubq1-1:1:1 (SEQ ID NO: 169)+I-SETit.Ubq1-1:1:1 (SEQ ID NO: 177)). Average GUS expression in the developing embryo 21 DAP was observed in plants transformed with pMON127442 ((P-SETit.Gapdh2-1:1:3 (SEQ ID NO: 55)+L-SETit.Gapdh2-1:1:1 (SEQ ID NO: 133)); pMON120709 ((P-SETit.Nrt2-1:1:3 (SEQ ID NO: 65)+L-SETit.Nrt2-1:1:2 (SEQ ID NO: 139)); pMON132037 ((EXP-SETit.Ubq1:1:1 (SEQ ID NO: 20) comprised of P-SETit.Ubq1-1:1:1 (SEQ ID NO: 102)+L-SETit.Ubq1-1:1:1 (SEQ ID NO: 169)+I-SETit.Ubq1-1:1:1 (SEQ ID NO: 177)); pMON120705 ((EXP-FMV.35S-SETit.Gst:b (SEQ ID NO: 3) comprised of E-FMV.35S-1:1:2 (SEQ ID NO: 179)+P-SETit.Gst-1:1:2 (SEQ ID NO: 59)+L-SETit.Gst-1:1:1 (SEQ ID NO: 135)) and pMON120699 ((EXP-FMV.35S-SETit.Gst:a (SEQ ID NO: 2) comprised of E-FMV.35S-1:1:2 (SEQ ID NO: 179)+P-SETit.Gst-1:1:1 (SEQ ID NO: 58)+L-SETit.Gst-1:1:1 (SEQ ID NO: 135)). Average GUS expression was also highest in plants transformed with pMON127442 ((P-SETit.Gapdh2-1:1:3 (SEQ ID NO: 55)+L-SETit.Gapdh2-1:1:1 (SEQ ID NO: 133)) and pMON120709 ((P-SETit.Nrt2-1:1:3 (SEQ ID NO: 65)+L-SETit.Nrt2-1:1:2 (SEQ ID NO: 139))

Plants transformed with the GUS expression vectors, pMON112215 ((P-SETit.Rcc3-1:1:1 (SEQ ID NO: 88)+L-SETit.Rcc3-1:1:1 (SEQ ID NO: 161)) were crossed with non-transformed LH244 plants to produce an F1 population of transformants. GUS expression levels were measured in selected tissues over the course of development. The F1 tissues used for this study included: imbibed seed embryo, imbibed seed endosperm, root (3 days after germination), coleoptiles (3 days after germination), V3 root, V3 leaf, V7 root, V7 mature leaf, VT (at tasseling, prior to reproduction) seminal root, VT internode, VT cob, VT anther, VT pollen, VT silk, kernel 7 days after pollination, embryo 21 days after pollination, endosperm 21 days after pollination, embryo 35 days after pollination, endosperm 35 days after pollination.

Drought stress was induced in R₀ V3 plants and in F1 V3 plants by withholding watering for 4 days allowing the water content to be reduced by at least 50% of the original water content of the fully watered plant. The drought protocol was comprised essentially of the following steps. V3 stage plants were deprived of water. As a corn plant experiences drought, the shape of the leaf will change from the usual healthy and unfolded appearance to a leaf demonstrating folding at the mid-rib vascular bundle and appearing V-shaped when viewed from the leaf tip to the stem. This change in morphology usually began to occur by about 2 days after the cessation of watering and was shown in earlier experiments to be associated with water loss of around 50% as measured by weight of pots prior to cessation of watering and weight of pots when the leaf curl morphology was observed in un-watered plants. Plants were considered to be under drought conditions, when the leaves showed wilting as evidenced by an inward curling (V-shape) of the leaf. This level of stress is considered to be a form of sub-lethal stress. Control leaf samples were taken from each plant for GUS testing prior to the induction of drought. Drought (indicated as "Des" in Table 5 below) was then induced and once each plant demonstrated drought induction as defined above, the plant was destroyed to acquire both root and leaf samples. GUS expression levels in the leaves were compared to the control tissue samples from the same plants prior to drought. For R₀ generation plants, fourteen plants for each vector were used. For F1 analysis, eight plants for each vector were used and GUS measures taken as described above. Four of the F1 plants were destroyed for tissue sampling for GUS assay (Des) after drought-induction. The other two F1 plants were allowed to recover and then destructively sampled to determine if the pattern of GUS expression under recovery was the same as that before drought was imposed.

In addition to drought, F1 germinating seedlings and F1 V3 stage plants transformed with the vectors presented in Table 2 were also exposed to conditions of cold to determine if the regulatory elements and chimeric regulatory elements demonstrated cold-induced expression of GUS. Sixty seeds, comprised of 6 seeds from each of 10 transformation events for each regulatory element or chimeric regulatory element, were tested for induction of gene expression under cold conditions. The seeds were germinated in petri plates on water saturated filter paper. Three days after germination, the seedlings were exposed to cold stress by placing the Petri dishes containing the germinated seedlings in a dark growth chamber set to 10 degrees Celsius for 24 hours. At the end of the 24 hour period, the root and coleoptiles tissues were sampled for quantitative GUS expression as described above. Whole plants were tested for induction of GUS expression under cold stress at V3 stage. Twenty V3 stage corn plants, comprised of 2 plants from each of 10 transformation events for each regulatory element or chimeric regulatory element, were exposed to a temperature of 12 degrees Celsius in a growth chamber for 24 hours. Plants in the growth chamber were grown under a white light fluence of 800 micro moles per meter squared per second with a light cycle of ten hours of white light and fourteen hours of darkness. After cold exposure, leaf and root tissues were sampled for quantitative GUS exposure as described above. Table 5 below shows the level of GUS expression in selected tissues in F1 plants transformed with pMON112215.

TABLE 5

F1 GUS expression in transgenic corn plants, transformed with pMON112215.

| Stages | Organ | Inducer | Mean | SE |
|---|---|---|---|---|
| Imbibed seed | Embryo | — | 22.6 | 1.54 |
| Imbibed seed | Endosperm | — | 7.48 | 1.64 |
| 3 DAG | Root | — | 0 | 0 |
| V3 | Root main | Unstressed | 0 | 0 |
| V3 | Root crown | — | 0 | 0 |
| V3 | Root main | Cold | 0 | 0 |
| V3 | Root crown | — | 0 | 0 |
| V3 | Root main | Des | 0 | 0 |
| V3 | Root crown | — | nd | nd |
| V7 | Root seminal | — | 0 | 0 |
| V7 | Root crown | — | 0 | 0 |
| VT | Root seminal | — | 8.26 | 1.38 |
| 3 DAG | Coleoptile | — | 0 | 0 |
| V3 | Leaf | Unstressed | 0 | 0 |
| V3 | Leaf | Cold | 0 | 0 |
| V3 | Leaf | Des | 6.18 | 0.3 |
| V7 | Leaf - Mature | — | 0 | 0 |
| VT | Internode | — | 9.83 | 3.47 |
| VT | Cob | — | 7.38 | 1.78 |
| VT | Anther | — | 1060.86 | 849.27 |
| VT | Pollen | — | 200.74 | 101.84 |
| VT | Silk | — | 16.63 | 9.45 |
| 21 DAP | Embryo | — | 18.6 | 2.18 |
| 35 DAP | Embryo | — | 4.16 | 1.35 |
| 10 DAP | Kernal | — | 0 | 0 |
| 21 DAP | Endosperm | — | 11.14 | 0 |
| 35 DAP | Endosperm | — | 3.26 | 2.27 |

F1 corn plants, transformed with pMON112215 ((P-SETit.Rcc3-1:1:1 (SEQ ID NO: 88)+L-SETit.Rcc3-1:1:1 (SEQ ID NO: 161)) demonstrated high levels of expression in VT anther tissue. Expression in pollen was also observed to be higher than in tissues other than anther. Expression was observed to be around background levels in developing embryo and endosperm, VT silk, VT seminal root and VT internode. Using more sensitive assay methods such as ELISA of TIC809 expression, the SETit.Rcc3 promoter and leader has been shown previously to drive expression of a transgene in stably transformed, corn root tissues (WO 2009/126470).

Example 3

Analysis of Regulatory Elements Driving GUS in Transgenic Corn

Corn root and leaf tissue from 12 to 13 day old seedlings is bombarded with plant GUS expression and control vectors to determine the capacity of transcriptional regulatory elements derived from *Setaria italica* to drive expression of a transgene, GUS.

Corn plant tissues were transformed with the plant GUS expression constructs, listed in Table 6, below. Regulatory elements presented in example 1 were cloned into a base plant expression vector using standard methods known in the art. The resulting plant expression vectors contained a right border region from *Agrobacterium tumefaciens*, a first transgene cassette to test the regulatory or chimeric regulatory element comprised of, a regulatory or chimeric regulatory element, operably linked to an intron derived from the HSP70 heat shock protein of *Zea mays* (I-Zm.DnaK-1:1:1, SEQ ID NO: 1102), operably linked to a coding sequence for β-glucuronidase (GUS) that possessed a processable intron (GUS-2, SEQ ID NO: 1091), operably linked to the 3' termination region from the rice lipid transfer protein gene (T-Os.LTP-1:1:1, SEQ ID NO: 1089); a second transgene selection cassette used for selection of transformed plant cells that conferred resistance to the herbicide glyphosate (driven by the rice Actin 1 transcriptional regulatory element group, SEQ ID NO: 1098), and a left border region from *A. tumefaciens*. The resulting plasmids, pMON129227, pMON129228, pMON129229, pMON129230, pMON129231, pMON129232, pMON129233, pMON129234, pMON129235, pMON129236, pMON129237, pMON129238, pMON129239, pMON129240, pMON129241, pMON129242, pMON129243, pMON129244, pMON129245, pMON129246, pMON129247, pMON129248, pMON129249, pMON129250, pMON129251, pMON129252, pMON129253, pMON129254, pMON129255, pMON129256, pMON129257, pMON129258 and pMON129259 were used to transform corn plant tissue using particle bombardment.

TABLE 6

Binary Plant Transformation Vectors, Regulatory or chimeric regulatory elements, GUS and 3' UTRs.

| Construct | Regulatory Elements | 3' UTR |
|---|---|---|
| pMON129227 | P-SETit.Cyp-1-1:1:1 (SEQ ID NO: 43) L-SETit.Cyp-1-1:1:1 (SEQ ID NO: 125) | T-Os.LTP-1:1:1 |
| pMON129228 | P-SETit.Cyp78a-1:1:2 (SEQ ID NO: 44) L-SETit.Cyp78a-1:1:1 (SEQ ID NO: 126) | T-Os.LTP-1:1:1 |
| pMON129229 | P-SETit.OMT2.1-1:1:2 (SEQ ID NO: 66) L-SETit.OMT2.1-1:1:1 (SEQ ID NO: 140) | T-Os.LTP-1:1:1 |
| pMON129230 | P-SETit.OMT2.2-1:1:2 (SEQ ID NO: 67) L-SETit.OMT2.2-1:1:2 (SEQ ID NO: 142) | T-Os.LTP-1:1:1 |
| pMON129231 | P-SETit.OMT2.3-1:1:1 (SEQ ID NO: 68) L-SETit.OMT2.2-1:1:1 (SEQ ID NO: 141) | T-Os.LTP-1:1:1 |
| pMON129232 | P-SETit.Grcw2-1:1:1 (SEQ ID NO: 56) L-SETit.Grcw2-1:1:1 (SEQ ID NO: 134) | T-Os.LTP-1:1:1 |
| pMON129233 | P-SETit.Prx2-1:1:3 (SEQ ID NO: 81) L-SETit.Prx2-1:1:2 (SEQ ID NO: 155) | T-Os.LTP-1:1:1 |
| pMON129234 | P-SETit.Srp-1:1:2 (SEQ ID NO: 92) L-SETit.Srp-1:1:1 (SEQ ID NO: 163) | T-Os.LTP-1:1:1 |

TABLE 6-continued

Binary Plant Transformation Vectors, Regulatory or chimeric regulatory elements, GUS and 3' UTRs.

| Construct | Regulatory Elements | 3' UTR |
|---|---|---|
| pMON129235 | P-SETit.LaDo-1:1:2 (SEQ ID NO: 62)<br>L-SETit.LaDo-1:1:1 (SEQ ID NO: 137) | T-Os.LTP-1:1:1 |
| pMON129236 | P-SETit.Aip-1:1:1 (SEQ ID NO: 27)<br>L-SETit.Aip-1:1:1 (SEQ ID NO: 109) | T-Os.LTP-1:1:1 |
| pMON129237 | P-SETit.Prx-1:1:1 (SEQ ID NO: 79)<br>L-SETit.Prx-1:1:1 (SEQ ID NO: 153) | T-Os.LTP-1:1:1 |
| pMON129238 | P-SETit.Cbl7-1:1:1 (SEQ ID NO: 34)<br>L-SETit.Cbl7-1:1:1 (SEQ ID NO: 115) | T-Os.LTP-1:1:1 |
| pMON129239 | P-SETit.Fst-1:1:1 (SEQ ID NO: 54)<br>L-SETit.Fst-1:1:1 (SEQ ID NO: 132) | T-Os.LTP-1:1:1 |
| pMON129240 | P-SETit.Cda-1:1:1 (SEQ ID NO: 36)<br>L-SETit.Cda-1:1:1 (SEQ ID NO: 117) | T-Os.LTP-1:1:1 |
| pMON129241 | P-SETit.Prx3-1:1:4 (SEQ ID NO: 83)<br>L-SETit.Prx3-1:1:1 (SEQ ID NO: 156) | T-Os.LTP-1:1:1 |
| pMON129242 | P-SETit.Prx3-1:1:3 (SEQ ID NO: 82)<br>L-SETit.Prx3-1:1:1 (SEQ ID NO: 156) | T-Os.LTP-1:1:1 |
| pMON129243 | P-SETit.Prx47-1:1:2 (SEQ ID NO: 84)<br>L-SETit.Prx47-1:1:1 (SEQ ID NO: 157) | T-Os.LTP-1:1:1 |
| pMON129244 | P-SETit.Eie-1:1:1 (SEQ ID NO: 49)<br>L-SETit.Eie-1:1:1 (SEQ ID NO: 129) | T-Os.LTP-1:1:1 |
| pMON129245 | P-SETit.Omt3-1:1:3 (SEQ ID NO: 69)<br>L-SETit.Omt3-1:1:1 (SEQ ID NO: 143) | T-Os.LTP-1:1:1 |
| pMON129246 | P-SETit.Cys-1:1:2 (SEQ ID NO: 45)<br>L-SETit.Cys-1:1:1 (SEQ ID NO: 127) | T-Os.LTP-1:1:1 |
| pMON129247 | P-SETit.Cys-1:1:3 (SEQ ID NO: 46)<br>L-SETit.Cys-1:1:1 (SEQ ID NO: 127) | T-Os.LTP-1:1:1 |
| pMON129248 | P-SETit.Ucc1-1:1:2 (SEQ ID NO: 105)<br>L-SETit.Ucc1-1:1:1 (SEQ ID NO: 170) | T-Os.LTP-1:1:1 |
| pMON129249 | P-SETit.Tip-1:1:4 (SEQ ID NO: 97)<br>L-SETit.Tip-1:1:1 (SEQ ID NO: 165) | T-Os.LTP-1:1:1 |
| pMON129250 | P-SETit.Prx72-1:1:2 (SEQ ID NO: 85)<br>L-SETit.Prx72-1:1:1 (SEQ ID NO: 158) | T-Os.LTP-1:1:1 |
| pMON129251 | P-SETit.Prx17-1:1:2 (SEQ ID NO: 80)<br>L-SETit.Prx17-1:1:1 (SEQ ID NO: 154) | T-Os.LTP-1:1:1 |
| pMON129252 | P-SETit.Mt1-1:1:2 (SEQ ID NO: 63)<br>L-SETit.Mt1-1:1:1 (SEQ ID NO: 138) | T-Os.LTP-1:1:1 |
| pMON129253 | P-SETit.Ali1-1:1:3 (SEQ ID NO: 31)<br>L-SETit.Ali1-1:1:1 (SEQ ID NO: 112) | T-Os.LTP-1:1:1 |
| pMON129254 | P-SETit.Rcc3-1:1:16 (SEQ ID NO: 91)<br>L-SETit.Rcc3-1:1:2 (SEQ ID NO: 162) | T-Os.LTP-1:1:1 |
| pMON129255 | P-SETit.Pip2-3-1:1:1 (SEQ ID NO: 72)<br>L-SETit.Pip2-3-1:1:1 (SEQ ID NO: 146) | T-Os.LTP-1:1:1 |
| pMON129256 | P-SETit.Tga6-1:1:2 (SEQ ID NO: 95) | T-Os.LTP-1:1:1 |
| pMON129257 | P-SETit.25509-1:1:3 (SEQ ID NO: 23) | T-Os.LTP-1:1:1 |
| pMON129258 | P-SETit.Grf-1:1:2 (SEQ ID NO: 57) | T-Os.LTP-1:1:1 |
| pMON129259 | P-SETit.Omt4_2-1:1:2 (SEQ ID NO: 70)<br>L-SETit.Omt4_2-1:1:1 (SEQ ID NO: 144) | T-Os.LTP-1:1:1 |

The plant transformation vector, pMON129227 is comprised of the promoter element, P-SETit.Cyp-1-1:1:1 (SEQ ID NO: 43), operably linked 5' to the leader element, L-SETit.Cyp-1-1:1:1 (SEQ ID NO: 125). The plant transformation vector, pMON129228 is comprised of the promoter element, P-SETit.Cyp78a-1:1:2 (SEQ ID NO: 44), operably linked 5' to the leader element, L-SETit.Cyp78a-1:1:1 (SEQ ID NO: 126). The plant transformation vector, pMON129229 is comprised of the promoter element, P-SETit.OMT2.1-1:1:2 (SEQ ID NO: 66), operably linked 5' to the leader element, L-SETit.OMT2.1-1:1:1 (SEQ ID NO: 140). The plant transformation vector, pMON129230 is comprised of the promoter element, P-SETit.OMT2.2-1:1:2 (SEQ ID NO: 67), operably linked 5' to the leader element, L-SETit.OMT2.2-1:1:2 (SEQ ID NO: 142). The plant transformation vector, pMON129231 is comprised of the promoter element, P-SETit.OMT2.3-1:1:1 (SEQ ID NO: 68), operably linked 5' to the leader element, L-SETit.OMT2-1:1:1 (SEQ ID NO: 141). The plant transformation vector, pMON129232 is comprised of the promoter element, P-SETit.Grcw2-1:1:1 (SEQ ID NO: 56), operably linked 5' to the leader element, L-SETit.Grcw2-1:1:1 (SEQ ID NO: 134). The plant transformation vector, pMON129233 is comprised of the promoter element, P-SETit.Prx2-1:1:3 (SEQ ID NO: 81), operably linked 5' to the leader element, L-SETit.Prx2-1:1:2 (SEQ ID NO: 155). The plant transformation vector, pMON129234 is comprised of the promoter element, P-SETit.Srp-1:1:2 (SEQ ID NO: 92), operably linked 5' to the leader element, L-SETit.Srp-1:1:1 (SEQ ID NO: 163). The plant transformation vector, pMON129235 is comprised of the promoter element, P-SETit.LaDo-1:1:2 (SEQ ID NO: 62), operably linked 5' to the leader element, L-SETit.LaDo-1:1:1 (SEQ ID NO: 137). The plant transformation vector, pMON129236 is comprised of the promoter element, P-SETit.Aip-1:1:1 (SEQ ID NO: 27), operably linked 5' to the leader element, L-SETit.Aip-1:1:1 (SEQ ID NO: 109). The plant transformation vector, pMON129237 is comprised of the promoter element, P-SETit.Prx-1:1:1 (SEQ ID NO: 79), operably linked 5' to the leader element, L-SETit.Prx-1:1:1 (SEQ ID NO: 153). The plant transformation vector, pMON129238 is comprised of the promoter element, P-SETit.Cbl7-1:1:1 (SEQ ID NO: 34), operably linked 5' to the leader element, L-SETit.Cbl7-1:1:1 (SEQ ID NO: 115). The plant transformation vector, pMON129239 is comprised of the promoter element, P-SETit.Fst-1:1:1 (SEQ ID NO: 54), operably linked 5' to the leader element, L-SETit.Fst-1:1:1 (SEQ ID NO: 132). The plant transformation vector, pMON129240 is comprised of the promoter element, P-SETit.Cda-1:1:1 (SEQ ID NO: 36), operably linked 5' to the leader element, L-SETit.Cda-1:1:1 (SEQ ID NO: 117). The plant transformation vector, pMON129241 is comprised of the promoter element, P-SETit.Prx3-1:1:4 (SEQ ID NO: 83), operably linked 5' to the leader element, L-SETit.Prx3-1:1:1 (SEQ ID NO: 156). The plant transformation vector, pMON129242 is comprised of the promoter element, P-SETit.Prx3-1:1:3 (SEQ ID NO: 82), operably linked 5' to the leader element, L-SETit.Prx3-1:1:1 (SEQ ID NO: 156). The plant transformation vector, pMON129243 is comprised of the promoter element, P-SETit.Prx47-1:1:2 (SEQ ID NO: 84), operably linked 5' to the leader element, L-SETit.Prx47-1:1:1 (SEQ ID NO: 157). The plant transformation vector, pMON129244 is comprised of the promoter element, P-SETit.Eie-1:1:1 (SEQ ID NO: 49), operably linked 5' to the leader element, L-SETit.Eie-1:1:1 (SEQ ID NO: 129). The plant transformation vector, pMON129245 is comprised of the promoter element, P-SETit.Omt3-1:1:3 (SEQ ID NO: 69), operably linked 5' to the leader element, L-SETit.Omt3-1:1:1 (SEQ ID NO: 143). The plant transformation vector, pMON129246 is comprised of the promoter element, P-SETit.Cys-1:1:2 (SEQ ID NO: 45), operably linked 5' to the leader element, L-SETit.Cys-1:1:1 (SEQ ID NO: 127). The plant transformation vector, pMON129247 is comprised of the promoter element, P-SETit.Cys-1:1:3 (SEQ ID NO: 46), operably linked 5' to the leader element, L-SETit.Cys-1:1:1 (SEQ ID NO: 127). The plant transformation vector, pMON129248 is comprised of the promoter element, P-SETit.Ucc1-1:1:2 (SEQ ID NO: 105), operably linked 5' to the leader element, L-SETit.Ucc1-1:1:1 (SEQ ID NO: 170). The plant transformation vector, pMON129249 is comprised of the promoter element, P-SETit.Tip-1:1:4 (SEQ ID NO: 97), operably linked 5' to the leader element, L-SETit.Tip-1:1:1 (SEQ ID NO: 165). The plant transformation vector, pMON129250 is comprised of the promoter element, P-SETit.Prx72-1:1:2 (SEQ ID NO: 85), operably linked 5' to the leader element, L-SETit.Prx72-1:1:1 (SEQ ID NO: 158). The plant transformation vector, pMON129251 is comprised of the promoter element, P-SETit.Prx17-1:1:2 (SEQ ID NO: 80), operably linked 5' to the leader element, L-SETit.Prx17-1:1:1 (SEQ ID NO: 154). The plant transformation vector, pMON129252 is comprised of the promoter element, P-SETit.Mt1-1:1:2 (SEQ ID NO: 63), operably linked 5' to the leader element, L-SETit.Mt1-1:1:1 (SEQ ID NO: 138). The plant transformation vector, pMON129253 is comprised of the promoter element, P-SETit.Ali1-1:1:3 (SEQ ID NO: 31), operably linked 5' to the leader element, L-SETit.Ali1-1:1:1 (SEQ ID NO: 112). The plant transformation vector, pMON129254 is comprised of the promoter element, P-SETit.Rcc3-1:1:16 (SEQ ID NO: 91), operably linked 5' to the leader element, L-SETit.Rcc3-1:1:2 (SEQ ID NO: 162). The plant transformation vector, pMON129255 is comprised of the promoter element, P-SETit.Pip2-3-1:1:1 (SEQ ID NO: 72), operably linked 5' to the leader element, L-SETit.Pip2-3-1:1:1 (SEQ ID NO: 146). The plant transformation vector, pMON129256 is comprised of the promoter element, P-SETit.Tga6-1:1:2 (SEQ ID NO: 95). The plant transformation vector, pMON129257 is comprised of the promoter element, P-SETit.25509-1:1:3 (SEQ ID NO: 23). The plant transformation vector, pMON129258 is comprised of the promoter element, P-SETit.Grf-1:1:2 (SEQ ID NO: 57). The plant transformation vector, pMON129259 is comprised of the promoter element, P-SETit.Omt4_2-1:1:2 (SEQ ID NO: 70), operably linked 5' to the leader element, L-SETit.Omt4_2-1:1:1 (SEQ ID NO: 144).

Corn plant tissues were transformed with plant GUS expression constructs, pMON129227, pMON129228, pMON129229, pMON129230, pMON129231, pMON129232, pMON129233, pMON129234, pMON129235, pMON129236, pMON129237, pMON129238, pMON129239, pMON129240, pMON129241, pMON129242, pMON129243, pMON129244, pMON129245, pMON129246, pMON129247, pMON129248, pMON129249, pMON129250, pMON129251, pMON129252, pMON129253, pMON129254, pMON129255, pMON129256, pMON129257, pMON129258 and pMON129259, using particle bombardment.

Corn plant tissue was transformed using particle bombardment methods known to those skilled in the art with the vectors described above. Briefly, LH244 corn seeds are surface sterilized and allowed to germinate in trays with a photoperiod of 16 hours light and 8 hours of darkness. After 12 to 13 days, tissue is harvested under sterile conditions from the seedlings and used for bombardment. Approximately 10 leaf and 15 root explants are used for bombardment of each experimental construct. The tissue samples are randomly placed on a petri dish containing plant culture medium. Ten micrograms of plasmid DNA is used to coat 0.6 micron gold particles (Catalog #165-2262 Bio-Rad, Hercules, Calif.) for bombardment. Macro-carriers were loaded with the DNA-coated gold particles (Catalog #165-2335 Bio-Rad, Hercules Calif.). A PDS 1000/He biolistic gun was used for transformation (Catalog #165-2257 Bio-Rad, Hercules Calif.). The bombarded root and leaf tissues were allowed to incubate in the dark for 24 hours at 26 degrees Celsius. Following this overnight incubation, the tissues are stained in solution for GUS expression overnight at 37 degrees Celsius. After staining overnight, the tissues are soaked in 70% ethanol overnight to remove chlorophyll and reveal the GUS staining. The tissues were then photographed and a rating scale of "0" to "4" reflecting the level of GUS expression is assigned to each construct.

Four control plasmids were also used for bombardment designated, pMON19469, pMON59327, pMON30098 and pMON103758. The plasmid vectors, pMON19469, pMON59327, and pMON103758 contained known transcriptional regulatory elements driving GUS expression and were used as comparators for expression. The plasmid vector, pMON30098 was comprised of a transgene cassette used for the expression of green fluorescent protein and served as a negative control in the bombardment assay. The plasmid vector, pMON19469 is comprised of a transgene cassette comprised of the P-CaMV.35S-enh-1:1:9 promoter (SEQ ID NO: 1096), derived from the Cauliflower mosaic virus 35S promoter, operably linked 5' to an intron derived from the HSP70 heat shock protein of Zea mays (I-Zm.DnaK-1:1:1, SEQ ID NO: 1102), operably linked to a coding sequence for β-glucuronidase (GUS-3, SEQ ID NO: 1092), operably linked 5' to the Nopaline synthase 3' termination region from *A. tumefaciens* (T-AGRtu.nos-1:1:13, SEQ ID NO: 1088). The plasmid vector, pMON59327 is comprised of a transgene cassette used for the expression of GUS which is comprised of the rice Rcc3 promoter (P-Os.Rcc3-1:1:24, SEQ ID NO: 1093) and leader (L-Os.Rcc3-1:1:1, SEQ ID NO: 1094), operably linked 5' to an intron derived from the HSP70 heat shock protein of Zea mays (I-Zm.DnaK-1:1:1, SEQ ID NO: 1102), operably linked 5' to a coding sequence for β-glucuronidase (GUS-3, SEQ ID NO: 1092), operably linked 5' to the Nopaline synthase 3' termination region from *A. tumefaciens* (T-AGRtu.nos-1:1:13, SEQ ID NO: 1088). The plasmid vector, pMON103758 is comprised of a transgene cassette used for the expression of GUS which is comprised of the rice Rcc3 promoter (P-Os.Rcc3-1:1:24, SEQ ID NO: 1093) and leader (L-Os.Rcc3-1:1:1, SEQ ID NO: 1094), operably linked 5' to an intron derived from the HSP70 heat shock protein of Zea mays (I-Zm.DnaK-1:1:1, SEQ ID NO: 1102), operably linked 5' to a coding sequence for β-glucuronidase (GUS-3, SEQ ID NO: 1092), operably linked 5' to the Nopaline synthase 3' termination region from *A. tumefaciens* (T-AGRtu.nos-1:1:13, SEQ ID NO: 1088). The plasmid vector, pMON30098 was comprised of a green fluorescent protein transgene cassette and served as a negative control in the bombardment assay and was comprised of a transgene cassette comprised of the transcriptional regulatory element group, EXP-CaMV.35S-enh (SEQ ID NO: 1095) which was further comprised of the promoter, P-CaMV.35S-enh-1:1:9 (SEQ ID NO: 1096), operably linked 5' to the leader element, L-CaMV.35S-1:1:2 (SEQ ID NO: 1097), operably linked 5' to an intron derived from the HSP70 heat shock protein of Zea mays (I-Zm.DnaK-1:1:1, SEQ ID NO: 1102), operably 5' linked to a coding sequence for GFP (CR-Av.GFP.nno, SEQ ID NO: 1103), operably linked 5' to the Nopaline synthase 3' termination region from *A. tumefaciens* (T-AGRtu.nos-1:1:13, SEQ ID NO: 1088).

The average GUS expression ratings from the particle bombarded assay are shown in Table 7 below.

TABLE 7

Average GUS expression ratings for bombarded corn root and leaf tissue transformed with listed plant GUS expression constructs.

| Construct | Regulatory Elements | Root | Leaf |
|---|---|---|---|
| pMON19469 | P-CaMV.35S-enh-1:1:9 promoter (SEQ ID NO: 1096) | 4 | 4 |
| pMON59327 | P-Os.Rcc3-1:1:24 (SEQ ID NO: 1093) L-Os.Rcc3-1:1:1 (SEQ ID NO: 1094) | 4 | 0 |
| pMON30098 (Neg. Control) | EXP-CaMV.35S-enh (SEQ ID NO: 1095) | 0 | 0 |
| pMON103758 | P-Os.Rcc3-1:1:24 (SEQ ID NO: 1093) L-Os.Rcc3-1:1:1 (SEQ ID NO: 1094) | 3 | 0 |

TABLE 7-continued

Average GUS expression ratings for bombarded corn root and leaf tissue transformed with listed plant GUS expression constructs.

| Construct | Regulatory Elements | Root | Leaf |
|---|---|---|---|
| pMON129227 | P-SETit.Cyp-1-1:1:1 (SEQ ID NO: 43) L-SETit.Cyp-1-1:1:1 (SEQ ID NO: 125) | 0 | 0 |
| pMON129228 | P-SETit.Cyp78a-1:1:2 (SEQ ID NO: 44) L-SETit.Cyp78a-1:1:1 (SEQ ID NO: 126) | 1 | 0 |
| pMON129229 | P-SETit.OMT2.1-1:1:2 (SEQ ID NO: 66) L-SETit.OMT2.1-1:1:1 (SEQ ID NO: 140) | 1 | 0 |
| pMON129230 | P-SETit.OMT2.2-1:1:2 (SEQ ID NO: 67) L-SETit.OMT2.2-1:1:2 (SEQ ID NO: 142) | 2 | 0 |
| pMON129231 | P-SETit.OMT2.3-1:1:1 (SEQ ID NO: 68) L-SETit.OMT2.2-1:1:1 (SEQ ID NO: 141) | 3 | 0 |
| pMON129232 | P-SETit.Grcw2-1:1:1 (SEQ ID NO: 56) L-SETit.Grcw2-1:1:1 (SEQ ID NO: 134) | 2 | 0 |
| pMON129233 | P-SETit.Prx2-1:1:3 (SEQ ID NO: 81) L-SETit.Prx2-1:1:2 (SEQ ID NO: 155) | 1 | 0 |
| pMON129234 | P-SETit.Srp-1:1:2 (SEQ ID NO: 92) L-SETit.Srp-1:1:1 (SEQ ID NO: 163) | 3 | 0 |
| pMON129235 | P-SETit.LaDo-1:1:2 (SEQ ID NO: 62) L-SETit.LaDo-1:1:1 (SEQ ID NO: 137) | 1 | 0 |
| pMON129236 | P-SETit.Aip-1:1:1 (SEQ ID NO: 27) L-SETit.Aip-1:1:1 (SEQ ID NO: 109) | 2 | 0 |
| pMON129237 | P-SETit.Prx-1:1:1 (SEQ ID NO: 79) L-SETit.Prx-1:1:1 (SEQ ID NO: 153) | 3 | 1 |
| pMON129238 | P-SETit.Cbl7-1:1:1 (SEQ ID NO: 34) L-SETit.Cbl7-1:1:1 (SEQ ID NO: 115) | 0 | 0 |
| pMON129239 | P-SETit.Fst-1:1:1 (SEQ ID NO: 54) L-SETit.Fst-1:1:1 (SEQ ID NO: 132) | 0 | 0 |
| pMON129240 | P-SETit.Cda-1:1:1 (SEQ ID NO: 36) L-SETit.Cda-1:1:1 (SEQ ID NO: 117) | 0 | 0 |
| pMON129241 | P-SETit.Prx3-1:1:4 (SEQ ID NO: 83) L-SETit.Prx3-1:1:1 (SEQ ID NO: 156) | 3 | 2 |
| pMON129242 | P-SETit.Prx3-1:1:3 (SEQ ID NO: 82) L-SETit.Prx3-1:1:1 (SEQ ID NO: 156) | 3 | 1 |
| pMON129243 | P-SETit.Prx47-1:1:2 (SEQ ID NO: 84) L-SETit.Prx47-1:1:1 (SEQ ID NO: 157) | 3 | 0 |
| pMON129244 | P-SETit.Eie-1:1:1 (SEQ ID NO: 49) L-SETit.Eie-1:1:1 (SEQ ID NO: 129) | 1 | 0 |
| pMON129245 | P-SETit.Omt3-1:1:3 (SEQ ID NO: 69) L-SETit.Omt3-1:1:1 (SEQ ID NO: 143) | 0 | 0 |
| pMON129246 | P-SETit.Cys-1:1:2 (SEQ ID NO: 45) L-SETit.Cys-1:1:1 (SEQ ID NO: 127) | 2 | 0 |
| pMON129247 | P-SETit.Cys-1:1:3 (SEQ ID NO: 46) L-SETit.Cys-1:1:1 (SEQ ID NO: 127) | 3 | 0 |
| pMON129248 | P-SETit.Ucc1-1:1:2 (SEQ ID NO: 105) L-SETit.Ucc1-1:1:1 (SEQ ID NO: 170) | 3 | 1 |
| pMON129249 | P-SETit.Tip-1:1:4 (SEQ ID NO: 97) L-SETit.Tip-1:1:1 (SEQ ID NO: 165) | 3 | 1 |
| pMON129250 | P-SETit.Prx72-1:1:2 (SEQ ID NO: 85) L-SETit.Prx72-1:1:1 (SEQ ID NO: 158) | 3 | 2 |
| pMON129251 | P-SETit.Prx17-1:1:2 (SEQ ID NO: 80) L-SETit.Prx17-1:1:1 (SEQ ID NO: 154) | 0 | 0 |
| pMON129252 | P-SETit.Mt1-1:1:2 (SEQ ID NO: 63) L-SETit.Mt1-1:1:1 (SEQ ID NO: 138) | 2 | 0 |
| pMON129253 | P-SETit.Ali1-1:1:3 (SEQ ID NO: 31) L-SETit.Ali1-1:1:1 (SEQ ID NO: 112) | 2 | 0 |
| pMON129254 | P-SETit.Rcc3-1:1:16 (SEQ ID NO: 91) L-SETit.Rcc3-1:1:2 (SEQ ID NO: 162) | 3 | 1 |
| pMON129255 | P-SETit.Pip2-3-1:1:1 (SEQ ID NO: 72) L-SETit.Pip2-3-1:1:1 (SEQ ID NO: 146) | 3 | 0 |
| pMON129256 | P-SETit.Tga6-1:1:2 (SEQ ID NO: 95) | 0 | 0 |
| pMON129257 | P-SETit.25509-1:1:3 (SEQ ID NO: 23) | 0 | 0 |
| pMON129258 | P-SETit.Grf-1:1:2 (SEQ ID NO: 57) | 0 | 0 |
| pMON129259 | P-SETit.Omt4_2-1:1:2 (SEQ ID NO: 70) L-SETit.Omt4_2-1:1:1 (SEQ ID NO: 144) | 0 | 0 |

The highest average level of GUS expression for root tissues transformed by particle bombardment were observed using the constructs, pMON129231 ((P-SETit.OMT2.3-1:1:1 (SEQ ID NO: 68)+L-SETit.OMT2.2-1:1:1 (SEQ ID NO: 141)); pMON129234 ((P-SETit.Srp-1:1:2 (SEQ ID NO: 92)+L-SETit.Srp-1:1:1 (SEQ ID NO: 163)); pMON129237 ((P-SETit.Prx-1:1:1 (SEQ ID NO: 79)+L-SETit.Prx-1:1:1 (SEQ ID NO: 153)); pMON129241 ((P-SETit.Prx3-1:1:4 (SEQ ID NO: 83)+L-SETit.Prx3-1:1:1 (SEQ ID NO: 156)); pMON129242 ((P-SETit.Prx3-1:1:3 (SEQ ID NO: 82)+L-SETit.Prx3-1:1:1 (SEQ ID NO: 156)); pMON129243 ((P-SETit.Prx47-1:1:2 (SEQ ID NO: 84)+L-SETit.Prx47-1:1:1 (SEQ ID NO: 157)); pMON129247 ((P-SETit.Cys-1:1:3 (SEQ ID NO: 46)+L-SETit.Cys-1:1:1 (SEQ ID NO: 127)); pMON129248 ((P-SETit.Ucc1-1:1:2 (SEQ ID NO: 105)+L-SETit.Ucc1-1:1:1 (SEQ ID NO: 170)); pMON129249 ((P-SETit.Tip-1:1:4 (SEQ ID NO: 97)+L-SETit.Tip-1:1:1 (SEQ ID NO: 165)); pMON129250 ((P-SETit.Prx72-1:1:2 (SEQ ID NO: 85)+L-SETit.Prx72-1:1:1 (SEQ ID NO: 158)); pMON129254 ((P-SETit.Rcc3-1:1:16 (SEQ ID NO: 91)+L-SETit.Rcc3-1:1:2 (SEQ ID NO: 162)) and pMON129255 ((P-SETit.Pip2-3-1:1:1 (SEQ ID NO: 72)+L-SETit.Pip2-3-1:1:1 (SEQ ID NO: 146)). Leaf expression was seen most highest in tissues bombarded with the constructs pMON129241 ((P-SETit.Prx3-1:1:4 (SEQ ID NO: 83)+L-SETit.Prx3-1:1:1 (SEQ ID NO: 156)) and pMON129250 ((P-SETit.Prx72-1:1:2 (SEQ ID NO: 85)+L-SETit.Prx72-1:1:1 (SEQ ID NO: 158)).

Example 4

Analysis of Regulatory Elements Driving GUS in Transgenic Corn

Corn plants were transformed with plant expression vectors containing the test regulatory elements driving expression of the β-glucuronidase (GUS) transgene, and the resulting plants were analyzed for GUS protein expression.

Corn plants were transformed with the plant GUS expression constructs, listed in Table 8, below. Regulatory elements presented in Example 1 for monocot expression were cloned into a base plant expression vector using standard methods known in the art. The resulting plant expression vectors contained a right border region from *Agrobacterium tumefaciens*, a first transgene cassette to test the regulatory or chimeric regulatory element comprised of, a regulatory or chimeric regulatory element, operably linked to an intron derived from the HSP70 heat shock protein of *Zea mays* (I-Zm.DnaK-1:1:1, SEQ ID NO: 1102), operably linked to a coding sequence for β-glucuronidase (GUS) that possessed a processable intron (GUS-2, SEQ ID NO: 1091), operably linked to the 3' termination region from the rice lipid transfer protein gene (T-Os.LTP-1:1:1, SEQ ID NO: 1089); a second transgene selection cassette used for selection of transformed plant cells that conferred resistance to the herbicide glyphosate (driven by the rice Actin 1 promoter, SEQ ID NO: 1098), and a left border region from *A. tumefaciens*. The resulting plasmids, pMON129227, pMON129228, pMON129229, pMON129230, pMON129231, pMON129232, pMON129233, pMON129234, pMON129235, pMON129236, pMON129237, pMON129238, pMON129239, pMON129240, pMON129241, pMON129242, pMON129243, pMON129244, pMON129245, pMON129246, pMON129247, pMON129249, pMON129250, pMON129251, pMON129252, pMON129253, pMON129254, pMON129255, pMON129256, pMON129257, pMON129258 and pMON129259 were used to transform corn plants.

TABLE 8

Binary Plant Transformation Vectors, Regulatory or chimeric regulatory elements, GUS and 3' UTRs.

| Construct | Regulatory Elements | 3' UTR |
|---|---|---|
| pMON129227 | P-SETit.Cyp-1-1:1:1 (SEQ ID NO: 43) L-SETit.Cyp-1-1:1:1 (SEQ ID NO: 125) | T-Os.LTP-1:1:1 |
| pMON129228 | P-SETit.Cyp78a-1:1:2 (SEQ ID NO: 44) L-SETit.Cyp78a-1:1:1 (SEQ ID NO: 126) | T-Os.LTP-1:1:1 |
| pMON129229 | P-SETit.OMT2.1-1:1:2 (SEQ ID NO: 66) L-SETit.OMT2.1-1:1:1 (SEQ ID NO: 140) | T-Os.LTP-1:1:1 |
| pMON129230 | P-SETit.OMT2.2-1:1:2 (SEQ ID NO: 67) L-SETit.OMT2.2-1:1:2 (SEQ ID NO: 142) | T-Os.LTP-1:1:1 |
| pMON129231 | P-SETit.OMT2.3-1:1:1 (SEQ ID NO: 68) L-SETit.OMT2.2-1:1:1 (SEQ ID NO: 141) | T-Os.LTP-1:1:1 |
| pMON129232 | P-SETit.Grcw2-1:1:1 (SEQ ID NO: 56) L-SETit.Grcw2-1:1:1 (SEQ ID NO: 134) | T-Os.LTP-1:1:1 |
| pMON129233 | P-SETit.Prx2-1:1:3 (SEQ ID NO: 81) L-SETit.Prx2-1:1:2 (SEQ ID NO: 155) | T-Os.LTP-1:1:1 |
| pMON129234 | P-SETit.Srp-1:1:2 (SEQ ID NO: 92) L-SETit.Srp-1:1:1 (SEQ ID NO: 163) | T-Os.LTP-1:1:1 |
| pMON129235 | P-SETit.LaDo-1:1:2 (SEQ ID NO: 62) L-SETit.LaDo-1:1:1 (SEQ ID NO: 137) | T-Os.LTP-1:1:1 |
| pMON129236 | P-SETit.Aip-1:1:1 (SEQ ID NO: 27) L-SETit.Aip-1:1:1 (SEQ ID NO: 109) | T-Os.LTP-1:1:1 |
| pMON129237 | P-SETit.Prx-1:1:1 (SEQ ID NO: 79) L-SETit.Prx-1:1:1 (SEQ ID NO: 153) | T-Os.LTP-1:1:1 |
| pMON129238 | P-SETit.Cbl7-1:1:1 (SEQ ID NO: 34) L-SETit.Cbl7-1:1:1 (SEQ ID NO: 115) | T-Os.LTP-1:1:1 |
| pMON129239 | P-SETit.Fst-1:1:1 (SEQ ID NO: 54) L-SETit.Fst-1:1:1 (SEQ ID NO: 132) | T-Os.LTP-1:1:1 |
| pMON129240 | P-SETit.Cda-1:1:1 (SEQ ID NO: 36) L-SETit.Cda-1:1:1 (SEQ ID NO: 117) | T-Os.LTP-1:1:1 |
| pMON129241 | P-SETit.Prx3-1:1:4 (SEQ ID NO: 83) L-SETit.Prx3-1:1:1 (SEQ ID NO: 156) | T-Os.LTP-1:1:1 |
| pMON129242 | P-SETit.Prx3-1:1:3 (SEQ ID NO: 82) L-SETit.Prx3-1:1:1 (SEQ ID NO: 156) | T-Os.LTP-1:1:1 |
| pMON129243 | P-SETit.Prx47-1:1:2 (SEQ ID NO: 84) L-SETit.Prx47-1:1:1 (SEQ ID NO: 157) | T-Os.LTP-1:1:1 |
| pMON129244 | P-SETit.Eie-1:1:1 (SEQ ID NO: 49) L-SETit.Eie-1:1:1 (SEQ ID NO: 129) | T-Os.LTP-1:1:1 |
| pMON129245 | P-SETit.Omt3-1:1:3 (SEQ ID NO: 69) L-SETit.Omt3-1:1:1 (SEQ ID NO: 143) | T-Os.LTP-1:1:1 |
| pMON129246 | P-SETit.Cys-1:1:2 (SEQ ID NO: 45) L-SETit.Cys-1:1:1 (SEQ ID NO: 127) | T-Os.LTP-1:1:1 |
| pMON129247 | P-SETit.Cys-1:1:3 (SEQ ID NO: 46) L-SETit.Cys-1:1:1 (SEQ ID NO: 127) | T-Os.LTP-1:1:1 |
| pMON129249 | P-SETit.Tip-1:1:4 (SEQ ID NO: 97) L-SETit.Tip-1:1:1 (SEQ ID NO: 165) | T-Os.LTP-1:1:1 |
| pMON129250 | P-SETit.Prx72-1:1:2 (SEQ ID NO: 85) L-SETit.Prx72-1:1:1 (SEQ ID NO: 158) | T-Os.LTP-1:1:1 |
| pMON129251 | P-SETit.Prx17-1:1:2 (SEQ ID NO: 80) L-SETit.Prx17-1:1:1 (SEQ ID NO: 154) | T-Os.LTP-1:1:1 |
| pMON129252 | P-SETit.Mt1-1:1:2 (SEQ ID NO: 63) L-SETit.Mt1-1:1:1 (SEQ ID NO: 138) | T-Os.LTP-1:1:1 |
| pMON129253 | P-SETit.Ali1-1:1:3 (SEQ ID NO: 31) L-SETit.Ali1-1:1:1 (SEQ ID NO: 112) | T-Os.LTP-1:1:1 |
| pMON129254 | P-SETit.Rcc3-1:1:16 (SEQ ID NO: 91) L-SETit.Rcc3-1:1:2 (SEQ ID NO: 162) | T-Os.LTP-1:1:1 |
| pMON129255 | P-SETit.Pip2-3-1:1:1 (SEQ ID NO: 72) L-SETit.Pip2-3-1:1:1 (SEQ ID NO: 146) | T-Os.LTP-1:1:1 |
| pMON129256 | P-SETit.Tga6-1:1:2 (SEQ ID NO: 95) | T-Os.LTP-1:1:1 |
| pMON129257 | P-SETit.25509-1:1:3 (SEQ ID NO: 23) | T-Os.LTP-1:1:1 |
| pMON129258 | P-SETit.Grf-1:1:2 (SEQ ID NO: 57) | T-Os.LTP-1:1:1 |
| pMON129259 | P-SETit.Omt4_2-1:1:2 (SEQ ID NO: 70) L-SETit.Omt4_2-1:1:1 (SEQ ID NO: 144) | T-Os.LTP-1:1:1 |

The plant transformation vector, pMON129227 is comprised of the promoter element, P-SETit.Cyp-1-1:1:1 (SEQ ID NO: 43), operably linked 5' to the leader element, L-SETit.Cyp-1-1:1:1 (SEQ ID NO: 125). The plant transformation vector, pMON129228 is comprised of the promoter element, P-SETit.Cyp78a-1:1:2 (SEQ ID NO: 44), operably linked 5' to the leader element, L-SETit.Cyp78a-1:1:1 (SEQ ID NO: 126). The plant transformation vector, pMON129229 is comprised of the promoter element, P-SETit.OMT2.1-1:1:2 (SEQ ID NO: 66), operably linked 5' to the leader element, L-SETit.OMT2.1-1:1:1 (SEQ ID NO: 140). The plant transformation vector, pMON129230 is comprised of the promoter element, P-SETit.OMT2.2-1:1:2 (SEQ ID NO: 67), operably linked 5' to the leader element, L-SETit.OMT2.2-1:1:2 (SEQ ID NO: 142). The plant transformation vector, pMON129231 is comprised of the promoter element, P-SETit.OMT2.3-1:1:1 (SEQ ID NO: 68), operably linked 5' to the leader element, L-SETit.OMT2.2-1:1:1 (SEQ ID NO: 141). The plant transformation vector, pMON129232 is comprised of the promoter element, P-SETit.Grcw2-1:1:1 (SEQ ID NO: 56), operably linked 5' to the leader element, L-SETit.Grcw2-1:1:1 (SEQ ID NO: 134). The plant transformation vector, pMON129233 is comprised of the promoter element, P-SETit.Prx2-1:1:3 (SEQ ID NO: 81), operably linked 5' to the leader element, L-SETit.Prx2-1:1:2 (SEQ ID NO: 155). The plant transformation vector, pMON129234 is comprised of the promoter element, P-SETit.Srp-1:1:2 (SEQ ID NO: 92), operably linked 5' to the leader element, L-SETit.Srp-1:1:1 (SEQ ID NO: 163). The plant transformation vector, pMON129235 is comprised of the promoter element, P-SETit.LaDo-1:1:2 (SEQ ID NO: 62), operably linked 5' to the leader element, L-SETit.LaDo-1:1:1 (SEQ ID NO: 137). The plant transformation vector, pMON129236 is comprised of the promoter element, P-SETit.Aip-1:1:1 (SEQ ID NO: 27), operably linked 5' to the leader element, L-SETit.Aip-1:1:1 (SEQ ID NO: 109). The plant transformation vector, pMON129237 is comprised of the promoter element, P-SETit.Prx-1:1:1 (SEQ ID NO: 79), operably linked 5' to the leader element, L-SETit.Prx-1:1:1 (SEQ ID NO: 153). The plant transformation vector, pMON129238 is comprised of the promoter element, P-SETit.Cbl7-1:1:1 (SEQ ID NO: 34), operably linked 5' to the leader element, L-SETit.Cbl7-1:1:1 (SEQ ID NO: 115). The plant transformation vector, pMON129239 is comprised of the promoter element, P-SETit.Fst-1:1:1 (SEQ ID NO: 54), operably linked 5' to the leader element, L-SETit.Fst-1:1:1 (SEQ ID NO: 132). The plant transformation vector, pMON129240 is comprised of the promoter element, P-SETit.Cda-1:1:1 (SEQ ID NO: 36), operably linked 5' to the leader element, L-SETit.Cda-1:1:1 (SEQ ID NO: 117). The plant transformation vector, pMON129241 is comprised of the promoter element, P-SETit.Prx3-1:1:4 (SEQ ID NO: 83), operably linked 5' to the leader element, L-SETit.Prx3-1:1:1 (SEQ ID NO: 156). The plant transformation vector, pMON129242 is comprised of the promoter element, P-SETit.Prx3-1:1:3 (SEQ ID NO: 82), operably linked 5' to the leader element, L-SETit.Prx3-1:1:1 (SEQ ID NO: 156). The plant transformation vector, pMON129243 is comprised of the promoter element, P-SETit.Prx47-1:1:2 (SEQ ID NO: 84), operably linked 5' to the leader element, L-SETit.Prx47-1:1:1 (SEQ ID NO: 157). The plant transformation vector, pMON129244 is comprised of the promoter element, P-SETit.Eie-1:1:1 (SEQ ID NO: 49), operably linked 5' to the leader element, L-SETit.Eie-1:1:1 (SEQ ID NO: 129). The plant transformation vector, pMON129245 is comprised of the promoter element, P-SETit.Omt3-1:1:3 (SEQ ID NO: 69), operably linked 5' to the leader element, L-SETit.Omt3-1:1:1 (SEQ ID NO: 143). The plant transformation vector, pMON129246 is comprised of the promoter element, P-SETit.Cys-1:1:2 (SEQ ID NO: 45), operably linked 5' to the leader element, L-SETit.Cys-1:1:1 (SEQ ID NO: 127). The plant transformation vector, pMON129247 is comprised of the promoter element, P-SETit.Cys-1:1:3 (SEQ ID NO: 46), operably linked 5' to the leader element, L-SETit.Cys-1:1:1 (SEQ ID NO: 127). The plant transformation vector, pMON129249 is comprised of the promoter element, P-SETit.Tip-1:1:4 (SEQ ID NO: 97), operably linked 5' to the leader element, L-SETit.Tip-1:1:1 (SEQ ID NO: 165). The plant transformation vector, pMON129250 is comprised of the promoter element, P-SETit.Prx72-1:1:2 (SEQ ID NO: 85), operably linked 5' to the leader element, L-SETit.Prx72-1:1:1 (SEQ ID NO: 158). The plant transformation vector, pMON129251 is comprised of the promoter element, P-SETit.Prx17-1:1:2 (SEQ ID NO: 80), operably linked 5' to the leader element, L-SETit.Prx17-1:1:1 (SEQ ID NO: 154). The plant transformation vector, pMON129252 is comprised of the promoter element, P-SETit.Mt1-1:1:2 (SEQ ID NO: 63), operably linked 5' to the leader element, L-SETit.Mt1-1:1:1 (SEQ ID NO: 138). The plant transformation vector, pMON129253 is comprised of the promoter element, P-SETit.Ali1-1:1:3 (SEQ ID NO: 31), operably linked 5' to the leader element, L-SETit.Ali1-1:1:1 (SEQ ID NO: 112). The plant transformation vector, pMON129254 is comprised of the promoter element, P-SETit.Rcc3-1:1:16 (SEQ ID NO: 91), operably linked 5' to the leader element, L-SETit.Rcc3-1:1:2 (SEQ ID NO: 162). The plant transformation vector, pMON129255 is comprised of the promoter element, P-SETit.Pip2-3-1:1:1 (SEQ ID NO: 72), operably linked 5' to the leader element, L-SETit.Pip2-3-1:1:1 (SEQ ID NO: 146). The plant transformation vector, pMON129256 is comprised of the promoter element, P-SETit.Tga6-1:1:2 (SEQ ID NO: 95). The plant transformation vector, pMON129257 is comprised of the promoter element, P-SETit.25509-1:1:3 (SEQ ID NO: 23). The plant transformation vector, pMON129258 is comprised of the promoter element, P-SETit.Grf-1:1:2 (SEQ ID NO: 57). The plant transformation vector, pMON129259 is comprised of the promoter element, P-SETit.Omt4_2-1:1:2 (SEQ ID NO: 70), operably linked 5' to the leader element, L-SETit.Omt4_2-1:1:1 (SEQ ID NO: 144).

Corn plants were transformed with plant GUS expression constructs, pMON129227, pMON129228, pMON129229, pMON129230, pMON129231, pMON129232, pMON129233, pMON129234, pMON129235, pMON129236, pMON129237, pMON129238, pMON129239, pMON129240, pMON129241, pMON129242, pMON129243, pMON129244, pMON129245, pMON129246, pMON129247, pMON129249, pMON129250, pMON129251, pMON129252, pMON129253, pMON129254, pMON129255, pMON129256, pMON129257, pMON129258 and pMON129259.

Plants were transformed using *Agrobacterium*-mediated transformations and LH244 corn seed embryos as outlined in Example 2. Leaf and root tissue were harvested from 1 to 5 transformants and assayed for GUS expression. Histochemical GUS analysis was used for qualitative expression analysis of transformed plants. Whole tissue sections were incubated with GUS staining solution X-Gluc (5-bromo-4-chloro-3-indolyl-b-glucuronide) (1 milligram/milliliter) for an appropriate length of time, rinsed, and visually inspected for blue coloration. GUS activity was qualitatively determined by direct visual inspection or inspection under a microscope using selected plant organs and tissues. The R0 plants were inspected for expression in the roots and leaves.

For quantitative analysis, total protein was extracted from selected tissues of transformed corn plants. One microgram of total protein was used with the fluorogenic substrate 4-methyleumbelliferyl-β-D-glucuronide (MUG) in a total reaction volume of 50 microliters. The reaction product, 4-methlyumbelliferone (4-MU), is maximally fluorescent at high pH, where the hydroxyl group is ionized. Addition of a basic solution of sodium carbonate simultaneously stops the assay and adjusts the pH for quantifying the fluorescent product. Fluorescence was measured with excitation at 365 nm, emission at 445 nm using a Fluoromax-3 with Micromax Reader, with slit width set at excitation 2 nm and emission 3 nm.

The average $R_0$ GUS expression for transgenic plants transformed with the constructs described in Table 8 are shown in Table 9 below.

TABLE 9

Average R0 GUS V3 Leaf and Root expression in transgenic corn plants, transformed with listed constructs.

| Construct | Regulatory Elements | V3 Root | V3 Leaf |
|---|---|---|---|
| pMON129227 | P-SETit.Cyp-1-1:1:1 (SEQ ID NO: 43) L-SETit.Cyp-1-1:1:1 (SEQ ID NO: 125) | 0.00 | 0.00 |
| pMON129228 | P-SETit.Cyp78a-1:1:2 (SEQ ID NO: 44) L-SETit.Cyp78a-1:1:1 (SEQ ID NO: 126) | 7.91 | 0.00 |
| pMON129229 | P-SETit.OMT2.1-1:1:2 (SEQ ID NO: 66) L-SETit.OMT2.1-1:1:1 (SEQ ID NO: 140) | 0.00 | 0.00 |
| pMON129230 | P-SETit.OMT2.2-1:1:2 (SEQ ID NO: 67) L-SETit.OMT2.2-1:1:2 (SEQ ID NO: 142) | 0.00 | 0.00 |
| pMON129231 | P-SETit.OMT2.3-1:1:1 (SEQ ID NO: 68) L-SETit.OMT2.2-1:1:1 (SEQ ID NO: 141) | 0.00 | 0.00 |
| pMON129232 | P-SETit.Grcw2-1:1:1 (SEQ ID NO: 56) L-SETit.Grcw2-1:1:1 (SEQ ID NO: 134) | 0.00 | 0.00 |
| pMON129233 | P-SETit.Prx2-1:1:3 (SEQ ID NO: 81) L-SETit.Prx2-1:1:2 (SEQ ID NO: 155) | 5.96 | nd |
| pMON129234 | P-SETit.Srp-1:1:2 (SEQ ID NO: 92) L-SETit.Srp-1:1:1 (SEQ ID NO: 163) | 0.00 | 0.00 |
| pMON129235 | P-SETit.LaDo-1:1:2 (SEQ ID NO: 62) L-SETit.LaDo-1:1:1 (SEQ ID NO: 137) | 0.00 | 0.00 |
| pMON129236 | P-SETit.Aip-1:1:1 (SEQ ID NO: 27) L-SETit.Aip-1:1:1 (SEQ ID NO: 109) | 0.00 | 0.00 |
| pMON129237 | P-SETit.Prx-1:1:1 (SEQ ID NO: 79) L-SETit.Prx-1:1:1 (SEQ ID NO: 153) | 10.66 | 0.00 |
| pMON129238 | P-SETit.Cbl7-1:1:1 (SEQ ID NO: 34) L-SETit.Cbl7-1:1:1 (SEQ ID NO: 115) | 0.00 | 0.00 |
| pMON129239 | P-SETit.Fst-1:1:1 (SEQ ID NO: 54) L-SETit.Fst-1:1:1 (SEQ ID NO: 132) | 2.86 | 0.00 |
| pMON129240 | P-SETit.Cda-1:1:1 (SEQ ID NO: 36) L-SETit.Cda-1:1:1 (SEQ ID NO: 117) | 0.00 | 0.00 |
| pMON129241 | P-SETit.Prx3-1:1:4 (SEQ ID NO: 83) L-SETit.Prx3-1:1:1 (SEQ ID NO: 156) | 7.49 | 0.00 |
| pMON129242 | P-SETit.Prx3-1:1:3 (SEQ ID NO: 82) L-SETit.Prx3-1:1:1 (SEQ ID NO: 156) | 1.90 | 0.00 |
| pMON129243 | P-SETit.Prx47-1:1:2 (SEQ ID NO: 84) L-SETit.Prx47-1:1:1 (SEQ ID NO: 157) | 9.26 | 0.00 |
| pMON129244 | P-SETit.Eie-1:1:1 (SEQ ID NO: 49) L-SETit.Eie-1:1:1 (SEQ ID NO: 129) | 2.35 | 0.00 |
| pMON129245 | P-SETit.Omt3-1:1:3 (SEQ ID NO: 69) L-SETit.Omt3-1:1:1 (SEQ ID NO: 143) | 0.00 | 0.00 |
| pMON129246 | P-SETit.Cys-1:1:2 (SEQ ID NO: 45) L-SETit.Cys-1:1:1 (SEQ ID NO: 127) | 0.00 | 0.00 |
| pMON129247 | P-SETit.Cys-1:1:3 (SEQ ID NO: 46) L-SETit.Cys-1:1:1 (SEQ ID NO: 127) | 0.00 | 0.00 |
| pMON129249 | P-SETit.Tip-1:1:4 (SEQ ID NO: 97) L-SETit.Tip-1:1:1 (SEQ ID NO: 165) | 34.79 | 0.00 |
| pMON129250 | P-SETit.Prx72-1:1:2 (SEQ ID NO: 85) L-SETit.Prx72-1:1:1 (SEQ ID NO: 158) | 0.00 | 0.00 |
| pMON129251 | P-SETit.Prx17-1:1:2 (SEQ ID NO: 80) L-SETit.Prx17-1:1:1 (SEQ ID NO: 154) | 0.00 | 0.00 |
| pMON129252 | P-SETit.Mt1-1:1:2 (SEQ ID NO: 63) L-SETit.Mt1-1:1:1 (SEQ ID NO: 138) | 0.00 | 24.92 |
| pMON129253 | P-SETit.Ali1-1:1:3 (SEQ ID NO: 31) L-SETit.Ali1-1:1:1 (SEQ ID NO: 112) | 0.00 | 11.58 |
| pMON129254 | P-SETit.Rcc3-1:1:16 (SEQ ID NO: 91) L-SETit.Rcc3-1:1:2 (SEQ ID NO: 162) | 9.39 | 0.00 |
| pMON129255 | P-SETit.Pip2-3-1:1:1 (SEQ ID NO: 72) L-SETit.Pip2-3-1:1:1 (SEQ ID NO: 146) | 79.81 | 0.00 |

TABLE 9-continued

Average R0 GUS V3 Leaf and Root expression in transgenic corn plants, transformed with listed constructs.

| Construct | Regulatory Elements | V3 Root | V3 Leaf |
|---|---|---|---|
| pMON129256 | P-SETit.Tga6-1:1:2 (SEQ ID NO: 95) | 6.91 | 0.00 |
| pMON129257 | P-SETit.25509-1:1:3 (SEQ ID NO: 23) | 0.00 | 0.00 |
| pMON129258 | P-SETit.Grf-1:1:2 (SEQ ID NO: 57) | 0.00 | 0.00 |
| pMON129259 | P-SETit.Omt4_2-1:1:2 (SEQ ID NO: 70) L-SETit.Omt4_2-1:1:1 (SEQ ID NO: 144) | 0.00 | 0.00 |

The highest average levels of GUS expression in the roots of V3 stage plants was observed in plants transformed with the constructs pMON129255 ((P-SETit.Pip2-3-1:1:1 (SEQ ID NO: 72)+L-SETit.Pip2-3-1:1:1 (SEQ ID NO: 146)) and pMON129249 ((P-SETit.Tip-1:1:4 (SEQ ID NO: 97)+L-SETit.Tip-1:1:1 (SEQ ID NO: 165)).

Example 5

Analysis of Actin and Tubulin Regulatory Elements Driving GUS in Corn Protoplasts Corn leaf protoplasts are transformed with plant expression vectors containing a test transcriptional regulatory element or transcriptional regulatory expression element group, driving expression of the β-glucuronidase (GUS) transgene, and compared to leaf protoplast in which expression of GUS is driven by known constitutive promoters.

Corn protoplast cells, derived from leaf tissue are transformed using methods known in the art with plant expression vectors to compare expression of a transgene driven by the transcriptional regulatory expression element groups, EXP-SETit.TubA3:1:3 (SEQ ID NO: 19), EXP-SETit.TubA2:1:3 (SEQ ID NO: 16), EXP-SETit.TubA2-2:1:1 (SEQ ID NO: 18), EXP-SETit.Act8:1:1 (SEQ ID NO: 9), EXP-SETit.Act8:1:2 (SEQ ID NO: 10), EXP-SETit.Act8:c (SEQ ID NO: 11), EXP-SETit.TubA2-1:1:2 (SEQ ID NO: 17) and EXP-SETit.TubA2:1:1 (SEQ ID NO: 15) with that of known constitutive promoters. Each transcriptional regulatory expression element group is cloned using methods known in the art into a plant expression vector shown in Table 10 below. The resulting plant expression vectors are comprised of a transgene cassette comprised of a transcriptional regulatory expression element group, operably linked 5' to a coding sequence for β-glucuronidase (GUS) (GUS-1 or GUS-3, represented by SEQ ID NOS: 1090 and 1092, respectively), which is operably linked 5' to a 3' termination region derived from the *A. tumefaciens* Nopaline synthase gene (T-AGRtu.nos-1:1:13, SEQ ID NO: 1088) or the wheat Hsp17 gene (T-Ta.Hsp17-1:1:1, SEQ ID NO: 1108).

Control plasmids used for comparison are constructed as described above and are comprised of a known constitutive, transcriptional regulatory expression element groups. The control plasmid vector, pMON19469 is comprised of the transcriptional regulatory element group, EXP-CaMV.35S-enh/I-Zm.DnaK-1:1:1 (SEQ ID NO: 1104). The control plasmid vector, pMON65328 is comprised of the transcriptional regulatory element group, EXP-CaMV.35S-enh-Lhcb1/I-Os.Act1-1:1:9 (SEQ ID NO: 1105). The control plasmid vector, pMON25455 is comprised of the transcriptional regulatory element group, EXP-Os.Act1:1:1 (SEQ ID NO: 1098). The control plasmid vector, pMON122605 is comprised of the transcriptional regulatory element group, EXP-Os.TubA-3:1:1 (SEQ ID NO: 1107). Each control vector transcriptional regulatory element group is operably linked 5' to a coding sequence for β-glucuronidase (GUS) (GUS-1 or GUS-3, represented by SEQ ID NOS: 1090 and 1092, respectively), which is operably linked 5' to a 3' termination region derived from the *A. tumefaciens* Nopaline synthase gene (T-AGRtu.nos-1:1:13, SEQ ID NO: 1088) or the wheat Hsp17 gene (T-Ta.Hsp17-1:1:1, SEQ ID NO: 1108). In addition, three controls are provided as controls for background GUS and luciferase expression, a no DNA control, an empty vector which is not designed for transgene expression and an expression vector used to express green fluorescent protein (GFP).

TABLE 10

GUS plant expression vectors and corresponding transcriptional regulatory expression element groups and constituent promoters, leaders and introns, and 3' UTR used for transformation of corn leaf protoplasts.

| Construct | Regulatory Elements | 3' UTR |
|---|---|---|
| pMON136270 | EXP-SETit.TubA3:1:3 (SEQ ID NO: 19) P-SETit.TubA3-1:1:3 (SEQ ID NO: 101) L-SETit.TubA3-1:1:1 (SEQ ID NO: 168) | T-AGRtu.nos-1:1:13 |
| pMON136272 | EXP-SETit.TubA2:1:3 (SEQ ID NO: 16) P-SETit.TubA2-1-1:1:3 (SEQ ID NO: 99) L-SETit.TubA2-1-1:1:1 (SEQ ID NO: 166) I-SETit.TubA2_1-1:1:2 (SEQ ID NO: 176) | T-AGRtu.nos-1:1:13 |
| pMON136275 | EXP-SETit.TubA2-2:1:1 (SEQ ID NO: 18) P-SETit.TubA2-2-1:1:3 (SEQ ID NO: 100) L-SETit.TubA2-2-1:1:1 (SEQ ID NO: 167) | T-AGRtu.nos-1:1:13 |
| pMON136276 | EXP-SETit.Act8:1:1 (SEQ ID NO: 9) P-SETit.Act8-1:1:5 (SEQ ID NO: 24) L-SETit.Act8-1:1:2 (SEQ ID NO: 106) I-SETit.Act8-1:1:2 (SEQ ID NO: 172) L-SETit.Act8-1:1:3 (SEQ ID NO: 107) | T-AGRtu.nos-1:1:13 |
| pMON136277 | EXP-SETit.Act8:1:2 (SEQ ID NO: 10) P-SETit.Act8-1:1:6 (SEQ ID NO: 25) L-SETit.Act8-1:1:2 (SEQ ID NO: 106) I-SETit.Act8-1:1:2 (SEQ ID NO: 172) L-SETit.Act8-1:1:3 (SEQ ID NO: 107) | T-AGRtu.nos-1:1:13 |
| pMON136278 | EXP-SETit.Act8:c (SEQ ID NO: 11) P-SETit.Act8-1-1:1:2 (SEQ ID NO: 26) L-SETit.Act8-1:1:4 (SEQ ID NO: 108) I-SETit.Act8-1:1:2 (SEQ ID NO: 172) L-SETit.Act8-1:1:3 (SEQ ID NO: 107) | T-AGRtu.nos-1:1:13 |
| pMON136279 | EXP-SETit.TubA2-1:1:2 (SEQ ID NO: 17) P-SETit.TubA2-1-1:1:2 (SEQ ID NO: 98) L-SETit.TubA2-1-1:1:1 (SEQ ID NO: 166) | T-AGRtu.nos-1:1:13 |

TABLE 10-continued

GUS plant expression vectors and corresponding transcriptional regulatory expression element groups and constituent promoters, leaders and introns, and 3' UTR used for transformation of corn leaf protoplasts.

| Construct | Regulatory Elements | 3' UTR |
|---|---|---|
| pMON136280 | EXP-SETit.TubA2:1:1 (SEQ ID NO: 15) P-SETit.TubA2-1-1:1:2 (SEQ ID NO: 98) L-SETit.TubA2-1-1:1:1 (SEQ ID NO: 166) I-SETit.TubA2_1-1:1:2 (SEQ ID NO: 176) | T-AGRtu.nos-1:1:13 |

The plant transformation vector, pMON136270 is comprised of the transcriptional regulatory element group, EXP-SETit.TubA3:1:3 (SEQ ID NO: 19), which is further comprised of the promoter element, P-SETit.TubA3-1:1:3 (SEQ ID NO: 101), operably linked 5' to the leader element, L-SETit.TubA3-1:1:1 (SEQ ID NO: 168). The plant transformation vector, pMON136272 is comprised of the transcriptional regulatory element group, EXP-SETit.TubA2:1:3 (SEQ ID NO: 16), which is further comprised of the promoter element, P-SETit.TubA2-1-1:1:3 (SEQ ID NO: 99), operably linked 5' to the leader element, L-SETit.TubA2-1-1:1:1 (SEQ ID NO: 166), operably linked 5' to the intron element, I-SETit.TubA2_1-1:1:2 (SEQ ID NO: 176). The plant transformation vector, pMON136275 is comprised of the transcriptional regulatory element group, EXP-SETit.TubA2-2:1:1 (SEQ ID NO: 18), which is further comprised of the promoter element, P-SETit.TubA2-2-1:1:3 (SEQ ID NO: 100), operably linked 5' to the leader element, L-SETit.TubA2-2-1:1:1 (SEQ ID NO: 167). The plant transformation vector, pMON136276 is comprised of the transcriptional regulatory element group, EXP-SETit.Act8:1:1 (SEQ ID NO: 9), which is further comprised of the promoter element, P-SETit.Act8-1:1:5 (SEQ ID NO: 24), operably linked 5' to the leader element, L-SETit.Act8-1:1:2 (SEQ ID NO: 106), operably linked 5' to the intron element, I-SETit.Act8-1:1:2 (SEQ ID NO: 172), operably linked 5' to the leader element, L-SETit.Act8-1:1:3 (SEQ ID NO: 107). The plant transformation vector, pMON136277 is comprised of the transcriptional regulatory element group, EXP-SETit.Act8:1:2 (SEQ ID NO: 10), which is further comprised of the promoter element, P-SETit.Act8-1:1:6 (SEQ ID NO: 25), operably linked 5' to the leader element, L-SETit.Act8-1:1:2 (SEQ ID NO: 106), operably linked 5' to the intron element, I-SETit.Act8-1:1:2 (SEQ ID NO: 172), operably linked 5' to the leader element, L-SETit.Act8-1:1:3 (SEQ ID NO: 107). The plant transformation vector, pMON136278 is comprised of the transcriptional regulatory element group, EXP-SETit.Act8:c (SEQ ID NO: 11), which is further comprised of the promoter element, P-SETit.Act8-1-1:1:2 (SEQ ID NO: 26), operably linked 5' to the leader element, L-SETit.Act8-1:1:4 (SEQ ID NO: 108), operably linked 5' to the intron element, I-SETit.Act8-1:1:2 (SEQ ID NO: 172), operably linked 5' to the leader element, L-SETit.Act8-1:1:3 (SEQ ID NO: 107). The plant transformation vector, pMON136279 is comprised of the transcriptional regulatory element group, EXP-SETit.TubA2-1:1:2 (SEQ ID NO: 17), which is further comprised of the promoter element, P-SETit.TubA2-1-1:1:2 (SEQ ID NO: 98), operably linked 5' to the leader element, L-SETit.TubA2-1-1:1:1 (SEQ ID NO: 166). The plant transformation vector, pMON136280 is comprised of the transcriptional regulatory element group, EXP-SETit.TubA2:1:1 (SEQ ID NO: 15), which is further comprised of the promoter element, P-SETit.TubA2-1-1:1:2 (SEQ ID NO: 98), operably linked 5' to the leader element, L-SETit.TubA2-1-1:1:1 (SEQ ID NO: 166), operably linked 5' to the intron element, I-SETit.TubA2_1-1:1:2 (SEQ ID NO: 176).

Two plasmids, for use in co-transformation and normalization of data, are also constructed using methods known in the art. Each plasmid contains a specific luciferase coding sequence which is driven by a constitutive transcriptional regulatory expression element group. The plant vector, pMON19437 is comprised of a transgene cassette comprised of a constitutive promoter (EXP-CaMV.35S-enh, SEQ ID NO: 1095), operably linked 5' to an intron, (I-Zm.DnaK-1: 1:1, SEQ ID NO: 1102), operably linked 5' to a firefly (*Photinus pyralis*) luciferase coding sequence (LUCIFERASE:1:3, SEQ ID NO: 1109), operably linked 5' to a 3' termination region from the *Agrobacterium tumefaciens* nopaline synthase gene (T-AGRtu.nos-1:1:13, SEQ ID NO: 1088). The plant vector, pMON63934 is comprised of a transgene cassette comprised of a constitutive transcriptional regulatory expression element group, (EXP-CaMV.35S-enh-Lhcb1, SEQ ID NO: 1106), operably linked 5' to a sea pansy (*Renilla reniformis*) luciferase coding sequence (CR-Ren.hRenilla Lucife-0:0:1, SEQ ID NO: 1110), operably linked 5' to a 3' termination region from the *Agrobacterium tumefaciens* nopaline synthase gene (T-AGRtu.nos-1:1:13, SEQ ID NO: 1088).

Corn leaf protoplasts are transformed using a PEG-based transformation method, similar to those known in the art. Protoplast cells are transformed with a DNA prep comprised of equimolar quantities of the two luciferase expression plasmids, pMON19437 and pMON63934 and one of the test plasmids and incubated overnight in total darkness. After incubation, the cells are rinsed, resuspended and lysed. Measurements of both GUS and luciferase are conducted using aliquots of each lysis preparation. Essentially, the collected, transformed protoplast cells are lysed in 5× passive lysis buffer (Promega). After allowing for lysis, aliquots of the lysed preparation are placed into two different small-well trays. One tray is used for GUS measurements. For quantitative analysis of GUS expression, total protein is extracted from lysis preparation. One microgram of total protein is used with the fluorogenic substrate 4-methyleum-belliferyl-β-D-glucuronide (MUG) in a total reaction volume of 50 microliters. The reaction product, 4-methlyum-belliferone (4-MU), is maximally fluorescent at high pH, where the hydroxyl group is ionized. Addition of a basic solution of sodium carbonate simultaneously stops the assay and adjusts the pH for quantifying the fluorescent product. Fluorescence is measured with excitation at 365 nm, emission at 445 nm using a Fluoromax-3 with Micromax Reader, with slit width set at excitation 2 nm and emission 3 nm. GUS values are expressed as pmol of 4-MU protein per minute per milligram protein (pmol 4-MU $min^{-1}$ $mg^{-1}$ protein).

The second tray is used to perform a dual luciferase assay using the dual luciferase reporter assay system (Promega, Madison, Wis.). All luciferase detection reagents are prepared as described by the manufacturer and assays conducted following the manufacturer's protocol (See for example, Promega Notes Magazine, No: 57, 1996, p. 02). Firefly luciferase reagent (LARII) is added to each sample and assay of the firefly luciferase activity recorded. Upon completion of the firefly luciferase assay, the firefly luminescence is quenched and luminescence of the *Renilla reniformis* luciferase simultaneously activated by adding Stop & Glo™ reagent to the sample. Measurement of the *Renilla reniformis* luciferase activity is recorded following activation of the *Renilla* luciferase. One or two transformations for each transcriptional regulatory expression element group are performed and the mean expression values for each transcriptional regulatory expression element group determined from several samples from each transformation experiment. Sample measurements are made using four replicates of each test transcriptional regulatory expression element group construct transformation, or alternatively, three replicates of each test transcriptional regulatory expression element group construct per one of two transformation experiments. The mean GUS and luciferase expression levels are provided in Tables 11 and 12. The firefly luciferase values are provided in the column labeled "Fluc" and the *Renilla* luciferase values are provided as in the column labeled "Rluc".

To compare the relative activity of each transcriptional regulatory expression element group, GUS values are expressed as a ratio of the mean GUS expression to the mean luciferase activity and normalized with respect to the expression levels observed for the transcriptional regulatory expression element groups EXP-Os.Act1:1:1 (SEQ ID NO: 1098) and EXP-Os.TubA-3:1:1 (SEQ ID NO: 1107). Table 11 below shows the mean GUS/Rluc ratios normalized with respect to EXP-Os.Act1:1: and EXP-Os.TubA-3:1:1 expression in corn protoplasts.

TABLE 11

Mean GUS/Rluc fold expression relative to EXP-Os.TubA-3:1:1expression in corn leaf protoplast cells.

| Construct | Transcriptional Regulatory Element Group | Mean Gus/RLuc | Mean Gus/Rluc Normalized with respect to EXP-Os.TubA-3:1:1 | Mean Gus/Rluc Normalized with respect to EXP-Os.Act1:1:1 |
|---|---|---|---|---|
| pMON19469 | EXP-CaMV.35S-enh/I-Zm.DnaK-1:1:1 (SEQ ID NO: 1102) | 2.640 | 2.718 | 1.054 |
| pMON65328 | EXP-CaMV.35S-enh-Lhcb1/I-Os.Act1-1:1:9 (SEQ ID NO: 1105) | 3.213 | 3.307 | 1.283 |
| pMON25455 | EXP-Os.Act1:1:1 (SEQ ID NO: 1098) | 2.504 | 2.578 | 1.000 |
| pMON122605 | EXP-Os.TubA-3:1:1 (SEQ ID NO: 1107) | 0.971 | 1.000 | 0.388 |
| pMON136270 | EXP-SETit.TubA3:1:3 (SEQ ID NO: 19) | 1.909 | 1.965 | 0.762 |
| pMON136272 | EXP-SETit.TubA2:1:3 (SEQ ID NO: 16) | 0.144 | 0.148 | 0.057 |
| pMON136275 | EXP-SETit.TubA2-2:1:1 (SEQ ID NO: 18) | 0.001 | 0.001 | 0.000 |
| pMON136276 | EXP-SETit.Act8:1:1 (SEQ ID NO: 9) | 0.353 | 0.364 | 0.141 |
| pMON136277 | EXP-SETit.Act8:1:2 (SEQ ID NO: 10) | 0.271 | 0.279 | 0.108 |
| pMON136278 | EXP-SETit.Act8:c (SEQ ID NO: 11) | 0.005 | 0.005 | 0.002 |
| pMON136279 | EXP-SETit.TubA2-1:1:2 (SEQ ID NO: 17) | 0.003 | 0.004 | 0.001 |
| pMON136280 | EXP-SETit.TubA2:1:1 (SEQ ID NO: 15) | 0.155 | 0.159 | 0.062 |

TABLE 12

Mean GUS/Fluc fold expression relative to EXP-Os.TubA-3:1:1expression in corn leaf protoplast cells.

| Construct | Transcriptional Regulatory Element Group | Mean Gus/FLuc | Gus/Fluc Normlized with respect to EXP-Os.TubA-3:1:1 | Gus/Fluc Normlized with respect to EXP-Os.Act1:1:1 |
|---|---|---|---|---|
| pMON19469 | EXP-CaMV.35S-enh/I-Zm.DnaK-1:1:1 (SEQ ID NO: 1102) | 21.580 | 18.072 | 2.521 |
| pMON65328 | EXP-CaMV.35S-enh-Lhcb1/I-Os.Act1-1:1:9 (SEQ ID NO: 1105) | 29.566 | 24.759 | 3.454 |
| pMON25455 | EXP-Os.Act1:1:1 (SEQ ID NO: 1098) | 8.559 | 7.167 | 1.000 |

TABLE 12-continued

Mean GUS/Fluc fold expression relative to EXP-Os.TubA-3:1:1 expression in corn leaf protoplast cells.

| Construct | Transcriptional Regulatory Element Group | Mean Gus/FLuc | Gus/Fluc Normlized with respect to EXP-Os.TubA-3:1:1 | Gus/Fluc Normlized with respect to EXP-Os.Act1:1:1 |
|---|---|---|---|---|
| pMON122605 | EXP-Os.TubA-3:1:1 (SEQ ID NO: 1107) | 1.194 | 1.000 | 0.140 |
| pMON136270 | EXP-SETit.TubA3:1:3 (SEQ ID NO: 19) | 2.222 | 1.861 | 0.260 |
| pMON136272 | EXP-SETit.TubA2:1:3 (SEQ ID NO: 16) | 0.302 | 0.253 | 0.035 |
| pMON136275 | EXP-SETit.TubA2-2:1:1 (SEQ ID NO: 18) | 0.002 | 0.002 | 0.000 |
| pMON136276 | EXP-SETit.Act8:1:1 (SEQ ID NO: 9) | 0.678 | 0.568 | 0.079 |
| pMON136277 | EXP-SETit.Act8:1:2 (SEQ ID NO: 10) | 0.550 | 0.460 | 0.064 |
| pMON136278 | EXP-SETit.Act8:c (SEQ ID NO: 11) | 0.009 | 0.008 | 0.001 |
| pMON136279 | EXP-SETit.TubA2-1:1:2 (SEQ ID NO: 17) | 0.004 | 0.004 | 0.001 |
| pMON136280 | EXP-SETit.TubA2:1:1 (SEQ ID NO: 15) | 0.378 | 0.317 | 0.044 |

The normalized GUS/Rluc and GUS/Fluc ratios provided in Tables 11 and 12 provide evidence that most of the expression elements are capable of driving GUS expression in corn leaf protoplasts. The constructs, pMON136275 (EXP-SETit.TubA2-2:1:1 (SEQ ID NO: 18)) and pMON136279 (EXP-SETit.TubA2-1:1:2 (SEQ ID NO: 17)) demonstrated the least amount of expression. The construct, pMON136270 (EXP-SETit.TubA3:1:3 (SEQ ID NO: 19)) provided the highest level of expression amongst the test elements relative to the constitutive controls.

Example 6

Analysis of Actin and Tubulin Regulatory Elements Driving GUS in Wheat Protoplasts Wheat leaf protoplasts were transformed with plant expression vectors containing a test transcriptional regulatory expression element group, driving expression of the β-glucuronidase (GUS) transgene, and compared to leaf protoplast in which expression of GUS is driven by known constitutive promoters.

Wheat protoplast cells, derived from leaf tissue were transformed using PEG based transformation methods known in the art with plant expression vectors to compare expression of a transgene driven by the transcriptional regulatory expression element groups, EXP-SETit.TubA3:1:3 (SEQ ID NO: 19), EXP-SETit.TubA2:1:3 (SEQ ID NO: 16), EXP-SETit.TubA2-2:1:1 (SEQ ID NO: 18), EXP-SETit.Act8:1:1 (SEQ ID NO: 9), EXP-SETit.Act8:1:2 (SEQ ID NO: 10), EXP-SETit.Act8:c (SEQ ID NO: 11), EXP-SETit.TubA2-1:1:2 (SEQ ID NO: 17) and EXP-SETit.TubA2:1:1 (SEQ ID NO: 15) with that of known constitutive promoters. Each transcriptional regulatory expression element group is cloned using methods known in the art into a plant expression vector shown in Table 10 in example 5 above. The resulting plant expression vectors are comprised of a transgene cassette comprised of a transcriptional regulatory expression element group, operably linked 5' to a coding sequence for β-glucuronidase (GUS) (GUS-1 or GUS-3, represented by SEQ ID NOS: 1090 and 1092, respectively), which is operably linked 5' to a 3' termination region derived from the A. tumefaciens Nopaline synthase gene (T-AGRtu.nos-1:1:13, SEQ ID NO: 56) or the wheat Hsp17 gene (T-Ta.Hsp17-1:1:1, SEQ ID NO: 57).

Control plasmid vector constructs and luciferase transformation control plasmid constructs were the same as those described in example 5. Measurements of both GUS and luciferase activity were conducted as described in example 5.

To compare the relative activity of each transcriptional regulatory expression element group, GUS values were expressed as a ratio of GUS to luciferase activity and normalized with respect to the expression levels observed for the transcriptional regulatory expression element group EXP-Os.TubA-3:1:1 (SEQ ID NO: 1107). Table 13 below shows the GUS/Rluc ratios normalized with respect to EXP-Os.TubA-3:1:1 expression in corn protoplasts.

GUS and luciferase activity are measured as described in Example 2 with replicate assays to determine the average level of GUS and luciferase expression in wheat protoplast cells. Mean GUS values are compared to the mean luciferase values and normalized with respect to expression seen in wheat protoplast cells transformed with a GUS expression vector in which GUS is driven by the transcriptional regulatory expression element group, EXP-Os.TubA-3:1:1 (SEQ ID NO: 65) to determine the relative fold activity of GUS expression driven by the transcriptional regulatory expression element groups, EXP-SETit.TubA3:1:3 (SEQ ID NO: 19), EXP-SETit.TubA2:1:3 (SEQ ID NO: 16), EXP-SETit.TubA2-2:1:1 (SEQ ID NO: 18), EXP-SETit.Act8:1:1 (SEQ ID NO: 9), EXP-SETit.Act8:1:2 (SEQ ID NO: 10), EXP-SETit.Act8:c (SEQ ID NO: 11), EXP-SETit.TubA2-1:1:2 (SEQ ID NO: 17) and EXP-SETit.TubA2:1:1 (SEQ ID NO: 15).

The mean GUS and luciferase expression levels are provided in Table 13. The Renilla luciferase values are provided in the column labeled "Rluc".

TABLE 13

Mean GUS/Rluc fold expression relative to EXP-Os.TubA-3:1:1 expression in corn leaf protoplast cells.

| Construct | Transcriptional Regulatory Element Group | Mean Gus/RLuc | Gus/Rluc Normalized with respect to EXP-Os.TubA-3:1:1 | Gus/Rluc Normalized with respect to EXP-Os.Act1:1:1 |
|---|---|---|---|---|
| pMON19469 | EXP-CaMV.35S-enh/I-Zm.DnaK-1:1:1 (SEQ ID NO: 1102) | 12.540 | 22.423 | 1.030 |
| pMON65328 | EXP-CaMV.35S-enh-Lhcb1/I-Os.Act1-1:1:9 (SEQ ID NO: 1105) | 16.371 | 29.274 | 1.345 |
| pMON25455 | EXP-Os.Act1:1:1 (SEQ ID NO: 1098) | 12.175 | 21.770 | 1.000 |
| pMON122605 | EXP-Os.TubA-3:1:1 (SEQ ID NO: 1107) | 0.559 | 1.000 | 0.046 |
| pMON136270 | EXP-SETit.TubA3:1:3 (SEQ ID NO: 19) | 2.300 | 4.112 | 0.189 |
| pMON136272 | EXP-SETit.TubA2:1:3 (SEQ ID NO: 16) | 0.933 | 1.669 | 0.077 |
| pMON136275 | EXP-SETit.TubA2-2:1:1 (SEQ ID NO: 18) | 0.028 | 0.051 | 0.002 |
| pMON136276 | EXP-SETit.Act8:1:1 (SEQ ID NO: 9) | 1.606 | 2.873 | 0.132 |
| pMON136277 | EXP-SETit.Act8:1:2 (SEQ ID NO: 10) | 1.281 | 2.291 | 0.105 |
| pMON136278 | EXP-SETit.Act8:c (SEQ ID NO: 11) | 0.051 | 0.091 | 0.004 |
| pMON136279 | EXP-SETit.TubA2-1:1:2 (SEQ ID NO: 17) | 0.037 | 0.066 | 0.003 |
| pMON136280 | EXP-SETit.TubA2:1:1 (SEQ ID NO: 15) | 1.516 | 2.710 | 0.125 |

The highest level of GUS expression in wheat protoplast was observed in cells transformed with the constructs pMON136270 (EXP-SETit.TubA3:1:3 (SEQ ID NO: 19)); pMON136276 (EXP-SETit.Act8:1:1 (SEQ ID NO: 9)); pMON136277 (EXP-SETit.Act8:1:2 (SEQ ID NO: 10)) and pMON136280 (EXP-SETit.TubA2:1:1 (SEQ ID NO: 15)).

Example 7

Identification of Transcriptional Regulatory Elements Used for Seed Expression Transcriptional regulatory elements comprising promoters, leaders, introns and 3' UTRs useful in providing expression of a transgene in plant seed and reproductive tissues are identified based upon the expression of expressed sequence tags (ESTs) in cDNA libraries made from messenger RNA isolated from seed, flower and other tissues derived from Foxtail millet (*Setaria italica* (L.) Beauv). Libraries of cDNA are made from tissues isolated from *S. italica* using methods known to those skilled in the art from flower tissue at 0, 4, 7, 14, 21 and 31 days after pollination (DAP) as well as leaf and root. The resulting cDNAs are sequenced using various sequencing methods known in the art. The resulting ESTs are assembled into clusters using bioinformatics software such as clc_ref_assemble_complete version 2.01.37139 (CLC bio USA, Cambridge, Mass. 02142). Transcript abundance of each cluster is determined by counting the number of cDNA reads for each cluster. Table 14 below shows cluster assemblies that have been produced using cDNAs from libraries made from *S. italica* tissue isolated from leaf, root and flower at 0, 4, 7, 14, 21 and 31 days after pollination (DAP) that demonstrate expression in specific windows of developing of the developing seed and were either not observed or minimally observed in the leaf and root. Each cluster is annotated using bioinformatics analysis methods such as nucleotide and protein BLAST against public and proprietary data of genes expressed in monocots and dicots. In many cases, a homolog to the cluster was not identified and is indicated in Table 14 as "No homolog".

TABLE 14

Foxtail millet EST clusters and annotations.

| Cluster ID | SEQ ID NO: | Annotation |
|---|---|---|
| SETIT-28JUL09-CLUS10381_5 | 925 | hypothetical protein SORBIDRAFT_03g000770 |

TABLE 14-continued

Foxtail millet EST clusters and annotations.

| Cluster ID | SEQ ID NO: | Annotation |
|---|---|---|
| SETIT-28JUL09-CLUS101265__2 | 926 | No homolog |
| SETIT-28JUL09-CLUS6475__-5 | 927 | Putative uncharacterized protein |
| SETIT-28JUL09-CLUS1019870__1 | 928 | Putative uncharacterized protein |
| SETIT-28JUL09-CLUS680767__-4 | 929 | Plastidial ADP-glucose transporter |
| SETIT-28JUL09-CLUS343678__3 | 930 | No homolog |
| SETIT-28JUL09-CLUS7568__3 | 931 | No homolog |
| SETIT-28JUL09-CLUS771450__2 | 932 | No homolog |
| SETIT-28JUL09-CLUS1164825__1 | 933 | No homolog |
| SETIT-28JUL09-CLUS1406__-46 | 934 | No homolog |
| SETIT-28JUL09-CLUS1165324__1 | 935 | No homolog |
| SETIT-28JUL09-CLUS1140244__1 | 936 | No homolog |
| SETIT-28JUL09-CLUS153853__-4 | 937 | No homolog |
| SETIT-28JUL09-CLUS19108__-4 | 938 | No homolog |
| SETIT-28JUL09-CLUS23464__-6 | 939 | Putative uncharacterized protein OS = Oryza |
| SETIT-28JUL09-CLUS1180442__1 | 940 | No homolog |
| SETIT-28JUL09-CLUS675196__13 | 941 | Zein-like seed storage protein (Fragment) |
| SETIT-28JUL09-CLUS83__2 | 942 | Granule-bound starch synthase |
| SETIT-28JUL09-CLUS16759__4 | 943 | No homolog |
| SETIT-28JUL09-CLUS5145__3 | 944 | No homolog |
| SETIT-28JUL09-CLUS1193060__1 | 945 | No homolog |
| SETIT-28JUL09-CLUS1187352__1 | 946 | No homolog |
| SETIT-28JUL09-CLUS733__4 | 947 | No homolog |
| SETIT-28JUL09-CLUS4206__-30 | 948 | No homolog |
| SETIT-28JUL09-CLUS4114__2 | 949 | No homolog |
| SETIT-28JUL09-CLUS674506__2 | 950 | Globulin-1 S allele |
| SETIT-28JUL09-CLUS674506__3 | 951 | Vicilin-like embryo storage protein OS = Zea |
| SETIT-28JUL09-CLUS53110__1 | 952 | No homolog |
| SETIT-28JUL09-CLUS2505__8 | 953 | No homolog |
| SETIT-28JUL09-CLUS2888__5 | 954 | Putative uncharacterized protein |
| SETIT-28JUL09-CLUS2219__3 | 955 | No homolog |
| SETIT-28JUL09-CLUS12533__-3 | 956 | Nucleoside diphosphate kinase |
| SETIT-28JUL09-CLUS12533__-6 | 957 | Nucleoside diphosphate kinase |
| SETIT-28JUL09-CLUS2300__3 | 958 | hypothetical protein SORBIDRAFT_01g043300 |
| SETIT-28JUL09-CLUS696559__1 | 959 | No homolog |
| SETIT-28JUL09-CLUS681829__1 | 960 | No homolog |
| SETIT-28JUL09-CLUS680981__1 | 961 | No homolog |
| SETIT-28JUL09-CLUS2305__6 | 962 | No homolog |
| SETIT-28JUL09-CLUS685018__1 | 963 | No homolog |
| SETIT-28JUL09-CLUS12299__7 | 964 | Polyprotein (Fragment); Ubiquitin 5 |
| SETIT-28JUL09-CLUS295335__-4 | 965 | No homolog |
| SETIT-28JUL09-CLUS206694__6 | 966 | No homolog |
| SETIT-28JUL09-CLUS1102871__1 | 967 | hypothetical protein SORBIDRAFT_03g001990 |
| SETIT-28JUL09-CLUS1104561__1 | 968 | No homolog |
| SETIT-28JUL09-CLUS2723__-8 | 969 | No homolog |
| SETIT-28JUL09-CLUS387500__3 | 970 | No homolog |
| SETIT-28JUL09-CLUS6331__-8 | 971 | hypothetical protein SORBIDRAFT_03g007310 |
| SETIT-28JUL09-CLUS1103723__1 | 972 | Os08g0402800 protein |
| SETIT-28JUL09-CLUS482__-8 | 973 | No homolog |
| SETIT-28JUL09-CLUS1096748__1 | 974 | No homolog |
| SETIT-28JUL09-CLUS1127439__1 | 975 | No homolog |
| SETIT-28JUL09-CLUS1115180__1 | 976 | No homolog |
| SETIT-28JUL09-CLUS1108597__1 | 977 | Putative hydrolase OS = Oryza sativa subsp. |
| SETIT-28JUL09-CLUS96386__-2 | 978 | No homolog |
| SETIT-28JUL09-CLUS373929__-2 | 979 | hypothetical protein SORBIDRAFT_09g021920 |
| SETIT-28JUL09-CLUS1090880__1 | 980 | Protection of telomeres 1a protein |

TABLE 14-continued

Foxtail millet EST clusters and annotations.

| Cluster ID | SEQ ID NO: | Annotation |
|---|---|---|
| SETIT-28JUL09-CLUS1130991_1 | 981 | No homolog |
| SETIT-28JUL09-CLUS1131180_1 | 982 | No homolog |
| SETIT-28JUL09-CLUS5112_3 | 983 | No homolog |
| SETIT-28JUL09-CLUS1020178_2 | 984 | No homolog |
| SETIT-28JUL09-CLUS1437_14 | 985 | Anther-specific proline-rich protein APG |
| SETIT-28JUL09-CLUS4707_5 | 986 | Putative uncharacterized protein |
| SETIT-28JUL09-CLUS1130710_1 | 987 | No homolog |
| SETIT-28JUL09-CLUS880479_1 | 988 | No homolog |
| SETIT-28JUL09-CLUS879579_1 | 989 | No homolog |
| SETIT-28JUL09-CLUS17065_3 | 990 | Putative uncharacterized protein OS = *Zea mays* |
| SETIT-28JUL09-CLUS1703_5 | 991 | hypothetical protein SORBIDRAFT_01g038035 |
| SETIT-28JUL09-CLUS878855_1 | 992 | No homolog |
| SETIT-28JUL09-CLUS35651_8 | 993 | No homolog |
| SETIT-28JUL09-CLUS533810_3 | 994 | Putative uncharacterized protein |
| SETIT-28JUL09-CLUS888639_1 | 995 | hypothetical protein SORBIDRAFT_08g019910 |
| SETIT-28JUL09-CLUS8608_2 | 996 | Putative uncharacterized protein |
| SETIT-28JUL09-CLUS48534_2 | 997 | hypothetical protein SORBIDRAFT_04g001090 |
| SETIT-28JUL09-CLUS8620_17 | 998 | No homolog |
| SETIT-28JUL09-CLUS31891_4 | 999 | No homolog |
| SETIT-28JUL09-CLUS6173_1 | 1000 | Os09g0539100 protein |
| SETIT-28JUL09-CLUS884159_1 | 1001 | hypothetical protein SORBIDRAFT_05g019890 |
| SETIT-28JUL09-CLUS112639_5 | 1002 | No homolog |
| SETIT-28JUL09-CLUS886862_1 | 1003 | No homolog |
| SETIT-28JUL09-CLUS52311_2 | 1004 | No homolog |
| SETIT-28JUL09-CLUS886157_1 | 1005 | No homolog |
| SETIT-28JUL09-CLUS4920_5 | 1006 | Phosphatidylinositol 4-kinase OS = *Oryza* |
| SETIT-28JUL09-CLUS1697_9 | 1007 | No homolog |
| SETIT-28JUL09-CLUS18000_5 | 1008 | hypothetical protein SORBIDRAFT_10g022890 |
| SETIT-28JUL09-CLUS10981_4 | 1009 | 6-phosphofructokinase |
| SETIT-28JUL09-CLUS880709_1 | 1010 | Ribosomal RNA apurinic site specific lyase |
| SETIT-28JUL09-CLUS882664_1 | 1011 | Os10g0374600 protein |
| SETIT-28JUL09-CLUS19159_2 | 1012 | hypothetical protein SORBIDRAFT_06g017240 |
| SETIT-28JUL09-CLUS5475_-2 | 1013 | No homolog |
| SETIT-28JUL09-CLUS1194621_1 | 1014 | 22 kD alpha canein 5 OS = *Saccharum officinarum*; Seed storage protein |
| SETIT-28JUL09-CLUS675196_9 | 1015 | Zein-like seed storage protein (Fragment) |
| SETIT-28JUL09-CLUS719393_1 | 1016 | 10 kD delta canein; Delta zein storage protein |
| SETIT-28JUL09-CLUS722936_1 | 1017 | 10 kD delta canein |
| SETIT-28JUL09-CLUS722936_-2 | 1018 | 10 kD delta canein |
| SETIT-28JUL09-CLUS684877_1 | 1019 | Alpha kafirin OS = *Sorghum bicolor* |
| SETIT-28JUL09-CLUS675196_-2 | 1020 | Zein-like seed storage protein (Fragment); Alpha-coixin |
| SETIT-28JUL09-CLUS691558_2 | 1021 | 27 kDa pennisetin |
| SETIT-28JUL09-CLUS764553_1 | 1022 | 22 kDa pennisetin OS = *Pennisetum americanum* |
| SETIT-28JUL09-CLUS675787_1 | 1023 | 21 kDa pennisetin OS = *Pennisetum americanum*; Alpha-coixin |
| SETIT-28JUL09-CLUS691558_-3 | 1024 | 27 kDa pennisetin |
| SETIT-28JUL09-CLUS675196_11 | 1025 | 22 kDa pennisetin OS = *Pennisetum americanum* |
| SETIT-28JUL09-CLUS722936_-3 | 1026 | No homolog |
| SETIT-28JUL09-CLUS695757_1 | 1027 | Putative uncharacterized protein |
| SETIT-28JUL09-CLUS681682_1 | 1028 | Delta-coixin OS = *Coix lachryma-jobi* PE = 2 SV = 1; Prolamine |
| SETIT-28JUL09-CLUS675531_1 | 1029 | N-methyltransferase |
| SETIT-28JUL09-CLUS674096_1 | 1030 | No homolog |
| SETIT-28JUL09-CLUS674121_1 | 1031 | Prolamine |
| SETIT-28JUL09-CLUS675389_2 | 1032 | No homolog |
| SETIT-28JUL09-CLUS677324_1 | 1033 | hypothetical protein SORBIDRAFT_01g012345 |

An analysis of the expression of cDNAs for each cluster presented in Table 14 is provided in Table 15 below. For flower tissue, the following total numbers of EST reads were performed; flower 0 DAP, 251341; flower 4 DAP, 39277; flower 7 DAP, 34330; flower 14 DAP, 34920; flower 21 DAP, 42321; flower 31 DAP, 257327. For leaf and root tissue, the following total numbers of EST reads were performed; leaf, 478570 and root, 434180.

TABLE 15

Count of cDNAs expressed corresponding to EST clusters.

| Cluster Annotation | DAP 0 | DAP 4 | DAP 7 | DAP 14 | DAP 21 | DAP 31 | Leaf | Root | Expression Window and Organ |
|---|---|---|---|---|---|---|---|---|---|
| SETIT-28JUL09-CLUS10381_5 | 17 | 331 | 0 | 0 | 0 | 0 | 0 | 0 | 0-7 |
| SETIT-28JUL09-CLUS101265_2 | 12 | 152 | 87 | 0 | 0 | 0 | 0 | 0 | 0-7 |
| SETIT-28JUL09-CLUS6475_-5 | 11 | 143 | 82 | 0 | 0 | 0 | 0 | 0 | 0-7 |
| SETIT-28JUL09-CLUS1019870_1 | 14 | 119 | 34 | 0 | 0 | 0 | 0 | 0 | 0-7 |
| SETIT-28JUL09-CLUS680767_-4 | 0 | 0 | 0 | 239 | 100 | 16 | 0 | 0 | 14-31 |
| SETIT-28JUL09-CLUS343678_3 | 0 | 0 | 0 | 491 | 0 | 0 | 0 | 0 | 14 |
| SETIT-28JUL09-CLUS7568_3 | 0 | 0 | 0 | 486 | 0 | 0 | 0 | 0 | 14 |
| SETIT-28JUL09-CLUS771450_2 | 0 | 0 | 0 | 481 | 0 | 0 | 0 | 0 | 14 |
| SETIT-28JUL09-CLUS1164825_1 | 0 | 0 | 0 | 419 | 0 | 0 | 0 | 0 | 14 |
| SETIT-28JUL09-CLUS1406_-46 | 0 | 0 | 0 | 324 | 0 | 0 | 0 | 0 | 14 |
| SETIT-28JUL09-CLUS1165324_1 | 0 | 0 | 0 | 323 | 0 | 0 | 0 | 0 | 14 |
| SETIT-28JUL09-CLUS1140244_1 | 0 | 0 | 0 | 310 | 0 | 0 | 0 | 0 | 14 |
| SETIT-28JUL09-CLUS153853_-4 | 0 | 0 | 0 | 304 | 0 | 0 | 0 | 0 | 14 |
| SETIT-28JUL09-CLUS19108_-4 | 0 | 0 | 0 | 138 | 115 | 0 | 0 | 0 | 14-21 |
| SETIT-28JUL09-CLUS23464_-6 | 0 | 0 | 0 | 132 | 111 | 0 | 0 | 0 | 14-21 |
| SETIT-28JUL09-CLUS1180442_1 | 0 | 0 | 0 | 294 | 247 | 0 | 0 | 0 | 14-21 |
| SETIT-28JUL09-CLUS675196_13 | 0 | 0 | 0 | 169 | 142 | 0 | 0 | 0 | 14-21 |
| SETIT-28JUL09-CLUS83_2 | 0 | 0 | 0 | 111 | 187 | 15 | 0 | 0 | 14-31 |
| SETIT-28JUL09-CLUS16759_4 | 0 | 0 | 0 | 0 | 525 | 0 | 0 | 0 | 21 |
| SETIT-28JUL09-CLUS5145_3 | 0 | 0 | 0 | 0 | 448 | 0 | 0 | 0 | 21 |
| SETIT-28JUL09-CLUS1193060_1 | 0 | 0 | 0 | 0 | 390 | 0 | 0 | 0 | 21 |
| SETIT-28JUL09-CLUS1187352_1 | 0 | 0 | 0 | 0 | 385 | 0 | 0 | 0 | 21 |
| SETIT-28JUL09-CLUS733_4 | 0 | 0 | 0 | 0 | 356 | 0 | 0 | 0 | 21 |
| SETIT-28JUL09-CLUS4206_-30 | 0 | 0 | 0 | 0 | 352 | 0 | 0 | 0 | 21 |
| SETIT-28JUL09-CLUS4114_2 | 0 | 0 | 0 | 0 | 324 | 0 | 0 | 0 | 21 |
| SETIT-28JUL09-CLUS674506_2 | 0 | 0 | 0 | 0 | 772 | 12 | 0 | 0 | 21-31 |
| SETIT-28JUL09-CLUS674506_3 | 0 | 0 | 0 | 0 | 545 | 9 | 0 | 0 | 21-31 |
| SETIT-28JUL09-CLUS53110_1 | 0 | 0 | 0 | 0 | 0 | 167 | 0 | 9 | 31 |
| SETIT-28JUL09-CLUS2505_8 | 0 | 0 | 0 | 0 | 0 | 547 | 0 | 0 | 31 |
| SETIT-28JUL09-CLUS2888_5 | 0 | 0 | 0 | 0 | 0 | 475 | 0 | 0 | 31 |
| SETIT-28JUL09-CLUS2219_3 | 0 | 0 | 0 | 0 | 0 | 369 | 0 | 0 | 31 |
| SETIT-28JUL09-CLUS12533_-3 | 0 | 0 | 0 | 0 | 0 | 363 | 0 | 0 | 31 |
| SETIT-28JUL09-CLUS12533_-6 | 0 | 0 | 0 | 0 | 0 | 311 | 0 | 0 | 31 |
| SETIT-28JUL09-CLUS2300_3 | 0 | 0 | 0 | 0 | 0 | 276 | 0 | 0 | 31 |

TABLE 15-continued

Count of cDNAs expressed corresponding to EST clusters.

| Cluster Annotation | DAP 0 | DAP 4 | DAP 7 | DAP 14 | DAP 21 | DAP 31 | Leaf | Root | Expression Window and Organ |
|---|---|---|---|---|---|---|---|---|---|
| SETIT-28JUL09-CLUS696559_1 | 0 | 0 | 0 | 0 | 0 | 250 | 0 | 0 | 31 |
| SETIT-28JUL09-CLUS681829_1 | 0 | 0 | 0 | 0 | 0 | 246 | 0 | 0 | 31 |
| SETIT-28JUL09-CLUS680981_1 | 0 | 0 | 0 | 0 | 0 | 235 | 0 | 0 | 31 |
| SETIT-28JUL09-CLUS2305_6 | 0 | 0 | 0 | 0 | 0 | 220 | 0 | 0 | 31 |
| SETIT-28JUL09-CLUS685018_1 | 0 | 0 | 0 | 0 | 0 | 217 | 0 | 0 | 31 |
| SETIT-28JUL09-CLUS12299_7 | 0 | 295 | 0 | 0 | 0 | 0 | 0 | 0 | 4 |
| SETIT-28JUL09-CLUS295335_-4 | 0 | 569 | 0 | 0 | 0 | 0 | 0 | 0 | 4 |
| SETIT-28JUL09-CLUS206694_6 | 0 | 387 | 0 | 0 | 0 | 0 | 0 | 0 | 4 |
| SETIT-28JUL09-CLUS1102871_1 | 0 | 350 | 0 | 0 | 0 | 0 | 0 | 0 | 4 |
| SETIT-28JUL09-CLUS1104561_1 | 0 | 348 | 0 | 0 | 0 | 0 | 0 | 0 | 4 |
| SETIT-28JUL09-CLUS2723_-8 | 0 | 338 | 0 | 0 | 0 | 0 | 0 | 0 | 4 |
| SETIT-28JUL09-CLUS387500_3 | 0 | 330 | 0 | 0 | 0 | 0 | 0 | 0 | 4 |
| SETIT-28JUL09-CLUS6331_-8 | 0 | 323 | 0 | 0 | 0 | 0 | 0 | 0 | 4 |
| SETIT-28JUL09-CLUS1103723_1 | 0 | 302 | 0 | 0 | 0 | 0 | 0 | 0 | 4 |
| SETIT-28JUL09-CLUS482_-8 | 0 | 90 | 208 | 0 | 0 | 0 | 0 | 0 | 4-7 |
| SETIT-28JUL09-CLUS1096748_1 | 0 | 112 | 129 | 0 | 0 | 0 | 0 | 0 | 4-7 |
| SETIT-28JUL09-CLUS1127439_1 | 0 | 110 | 127 | 0 | 0 | 0 | 0 | 0 | 4-7 |
| SETIT-28JUL09-CLUS1115180_1 | 0 | 104 | 120 | 0 | 0 | 0 | 0 | 0 | 4-7 |
| SETIT-28JUL09-CLUS1108597_1 | 0 | 98 | 113 | 0 | 0 | 0 | 0 | 0 | 4-7 |
| SETIT-28JUL09-CLUS96386_-2 | 0 | 96 | 110 | 0 | 0 | 0 | 0 | 0 | 4-7 |
| SETIT-28JUL09-CLUS373929_-2 | 0 | 91 | 104 | 0 | 0 | 0 | 0 | 0 | 4-7 |
| SETIT-28JUL09-CLUS1090880_1 | 0 | 90 | 104 | 0 | 0 | 0 | 0 | 0 | 4-7 |
| SETIT-28JUL09-CLUS1130991_1 | 0 | 0 | 562 | 0 | 0 | 0 | 0 | 0 | 7 |
| SETIT-28JUL09-CLUS1131180_1 | 0 | 0 | 495 | 0 | 0 | 0 | 0 | 0 | 7 |
| SETIT-28JUL09-CLUS5112_3 | 0 | 0 | 484 | 0 | 0 | 0 | 0 | 0 | 7 |
| SETIT-28JUL09-CLUS1020178_2 | 0 | 0 | 471 | 0 | 0 | 0 | 0 | 0 | 7 |
| SETIT-28JUL09-CLUS1437_14 | 0 | 0 | 461 | 0 | 0 | 0 | 0 | 0 | 7 |
| SETIT-28JUL09-CLUS4707_5 | 0 | 0 | 446 | 0 | 0 | 0 | 0 | 0 | 7 |
| SETIT-28JUL09-CLUS1130710_1 | 0 | 0 | 427 | 0 | 0 | 0 | 0 | 0 | 7 |
| SETIT-28JUL09-CLUS880479_1 | 549 | 0 | 0 | 0 | 0 | 0 | 0 | 0 | Ovule pollen |
| SETIT-28JUL09-CLUS879579_1 | 405 | 0 | 0 | 0 | 0 | 0 | 0 | 0 | Ovule pollen |
| SETIT-28JUL09-CLUS17065_3 | 382 | 0 | 0 | 0 | 0 | 0 | 0 | 0 | Ovule pollen |
| SETIT-28JUL09-CLUS1703_5 | 287 | 0 | 0 | 0 | 0 | 0 | 0 | 8 | Ovule pollen |
| SETIT-28JUL09-CLUS878855_1 | 280 | 0 | 0 | 0 | 0 | 0 | 0 | 0 | Ovule pollen |
| SETIT-28JUL09-CLUS35651_8 | 225 | 0 | 0 | 0 | 0 | 0 | 0 | 0 | Ovule pollen |
| SETIT-28JUL09-CLUS533810_3 | 203 | 0 | 0 | 0 | 0 | 0 | 0 | 0 | Ovule pollen |
| SETIT-28JUL09-CLUS888639_1 | 198 | 0 | 0 | 0 | 0 | 0 | 0 | 0 | Ovule pollen |

TABLE 15-continued

Count of cDNAs expressed corresponding to EST clusters.

| Cluster Annotation | DAP 0 | DAP 4 | DAP 7 | DAP 14 | DAP 21 | DAP 31 | Leaf | Root | Expression Window and Organ |
|---|---|---|---|---|---|---|---|---|---|
| SETIT-28JUL09-CLUS8608_2 | 196 | 0 | 0 | 0 | 0 | 0 | 0 | 0 | Ovule pollen |
| SETIT-28JUL09-CLUS48534_2 | 175 | 0 | 0 | 0 | 0 | 0 | 0 | 0 | Ovule pollen |
| SETIT-28JUL09-CLUS8620_17 | 172 | 0 | 0 | 0 | 0 | 0 | 0 | 0 | Ovule pollen |
| SETIT-28JUL09-CLUS31891_4 | 171 | 0 | 0 | 0 | 0 | 0 | 0 | 0 | Ovule pollen |
| SETIT-28JUL09-CLUS6173_1 | 159 | 0 | 0 | 0 | 0 | 0 | 0 | 0 | Ovule pollen |
| SETIT-28JUL09-CLUS884159_1 | 155 | 0 | 0 | 0 | 0 | 0 | 0 | 0 | Ovule pollen |
| SETIT-28JUL09-CLUS112639_5 | 149 | 0 | 0 | 0 | 0 | 0 | 0 | 0 | Ovule pollen |
| SETIT-28JUL09-CLUS886862_1 | 144 | 0 | 0 | 0 | 0 | 0 | 0 | 0 | Ovule pollen |
| SETIT-28JUL09-CLUS52311_2 | 138 | 0 | 0 | 0 | 0 | 0 | 0 | 0 | Ovule pollen |
| SETIT-28JUL09-CLUS886157_1 | 136 | 0 | 0 | 0 | 0 | 0 | 0 | 0 | Ovule pollen |
| SETIT-28JUL09-CLUS4920_5 | 133 | 0 | 0 | 0 | 0 | 0 | 0 | 0 | Ovule pollen |
| SETIT-28JUL09-CLUS1697_9 | 132 | 0 | 0 | 0 | 0 | 0 | 0 | 0 | Ovule pollen |
| SETIT-28JUL09-CLUS18000_5 | 129 | 0 | 0 | 0 | 0 | 0 | 0 | 0 | Ovule pollen |
| SETIT-28JUL09-CLUS10981_4 | 129 | 0 | 0 | 0 | 0 | 0 | 0 | 0 | Ovule pollen |
| SETIT-28JUL09-CLUS880709_1 | 129 | 0 | 0 | 0 | 0 | 0 | 0 | 0 | Ovule pollen |
| SETIT-28JUL09-CLUS882664_1 | 128 | 0 | 0 | 0 | 0 | 0 | 0 | 0 | Ovule pollen |
| SETIT-28JUL09-CLUS19159_2 | 128 | 0 | 0 | 0 | 0 | 0 | 0 | 0 | Ovule pollen |
| SETIT-28JUL09-CLUS5475_-2 | 0 | 0 | 1721 | 12386 | 34684 | 11782 | 0 | 0 | Seed |
| SETIT-28JUL09-CLUS1194621_1 | 0 | 0 | 1386 | 9267 | 23798 | 8799 | 0 | 0 | Seed |
| SETIT-28JUL09-CLUS675196_9 | 0 | 0 | 1232 | 17098 | 22397 | 17083 | 0 | 0 | Seed |
| SETIT-28JUL09-CLUS719393_1 | 0 | 0 | 1184 | 13872 | 15107 | 13799 | 0 | 0 | Seed |
| SETIT-28JUL09-CLUS722936_1 | 0 | 0 | 1184 | 23792 | 30815 | 25296 | 0 | 0 | Seed |
| SETIT-28JUL09-CLUS722936_-2 | 0 | 0 | 1179 | 20955 | 22818 | 17587 | 0 | 0 | Seed |
| SETIT-28JUL09-CLUS684877_1 | 0 | 58 | 1003 | 5775 | 18118 | 5089 | 0 | 0 | Seed |
| SETIT-28JUL09-CLUS675196_-2 | 0 | 0 | 955 | 27322 | 31248 | 23018 | 0 | 0 | Seed |
| SETIT-28JUL09-CLUS691558_2 | 0 | 0 | 878 | 18204 | 29860 | 18448 | 0 | 0 | Seed |
| SETIT-28JUL09-CLUS764553_1 | 0 | 0 | 771 | 10897 | 12055 | 6685 | 0 | 0 | Seed |
| SETIT-28JUL09-CLUS675787_1 | 0 | 48 | 547 | 11309 | 12229 | 11428 | 0 | 0 | Seed |
| SETIT-28JUL09-CLUS691558_-3 | 0 | 0 | 511 | 7149 | 9793 | 4697 | 0 | 0 | Seed |
| SETIT-28JUL09-CLUS675196_11 | 0 | 0 | 478 | 5648 | 6182 | 5752 | 0 | 0 | Seed |
| SETIT-28JUL09-CLUS722936_-3 | 0 | 0 | 255 | 4537 | 4906 | 5131 | 0 | 0 | Seed |
| SETIT-28JUL09-CLUS695757_1 | 0 | 0 | 240 | 2803 | 3438 | 2313 | 0 | 0 | Seed |
| SETIT-28JUL09-CLUS681682_1 | 0 | 0 | 210 | 5982 | 6290 | 5382 | 0 | 0 | Seed |
| SETIT-28JUL09-CLUS675531_1 | 0 | 58 | 178 | 573 | 346 | 458 | 0 | 0 | Seed |
| SETIT-28JUL09-CLUS 674096_1 | 0 | 0 | 114 | 1648 | 2816 | 1837 | 0 | 0 | Seed |

TABLE 15-continued

Count of cDNAs expressed corresponding to EST clusters.

| Cluster Annotation | DAP 0 | DAP 4 | DAP 7 | DAP 14 | DAP 21 | DAP 31 | Leaf | Root | Expression Window and Organ |
|---|---|---|---|---|---|---|---|---|---|
| SETIT-28JUL09-CLUS675389_2 | 0 | 0 | 102 | 6728 | 7852 | 7164 | 0 | 0 | Seed |
| SETIT-28JUL09-CLUS677324_1 | 0 | 56 | 65 | 133 | 74 | 59 | 0 | 0 | Seed |

As can be seen in Table 15 above, many of the identified clusters demonstrate expression in specific windows of seed development; at 0 DAP in which expression is inferred to be in both ovule and pollen, or during the seed development window from 4 to 31 DAP. The identified cDNA clusters were used to design primers, which were then used with GenomeWalker™ (Clontech Laboratories, Inc, Mountain View, Calif.) libraries constructed following the manufacturer's protocol to clone the 5' region of the corresponding genomic DNA sequence. In the case of promoters leaders and introns, this cloned region contained the 5' transcriptional regulatory, 5' UTR and if present, intron sequence upstream of the protein-coding region for each gene from *S. italica*. Using this sequence, regulatory elements were bioinformatically identified within the 5' region for each gene. Bioinformatic analysis was used to identify the transcriptional start site (TSS) and any bi-directionality, introns, or upstream coding sequence present in the sequence. Using the results of this analysis, regulatory elements were defined within the 5' sequence upstream of the coding sequence of the gene. Primers were then designed to amplify the regulatory elements. The corresponding DNA molecule for each regulatory element was amplified using standard polymerase chain reaction conditions with primers containing unique restriction enzyme sites and genomic DNA isolated from *S. italica*. The resulting DNA fragments were ligated into a base plant expression vector using standard restriction enzyme digestion of compatible restriction sites and DNA ligation methods. In some cases, high sequence identity between some leaders provided the discovery of regulatory elements from homologous genes. The resulting transcriptional regulatory element groups, promoters, leaders and introns identified through this analysis are presented in Table 16 below:

TABLE 16

Transcriptional regulatory element groups (EXP), Promoters (P), leaders (L) and introns (I) identified using expression analysis.

| Annotation | SEQ ID NO: | Description |
|---|---|---|
| EXP-SETit.CLUS120796-1 | 12 | Cluster 120796-1 |
| EXP-SETit.CLUS19108 | 13 | Cluster 19108 |
| EXP-SETit.Ubq5 | 22 | Ubiquitin 5 |
| P-SETit.Alc1-1:1:1 | 28 | Alpha-coixin |
| P-SETit.Alc1-1:1:2 | 29 | Alpha-coixin |
| P-SETit.Alc2-1:1:2 | 30 | Alpha-coixin |
| P-SETit.CLUS1164825-1-1:1:1 | 37 | Cluster 1164825-1 |
| P-SETit.CLUS1165324-1:1:1 | 38 | Cluster 1165324-1 |
| P-SETit.CLUS120796-1-1:1:1 | 39 | Cluster 120796-1 |
| P-SETit.CLUS19108-1:1:2 | 40 | Cluster 19108 |
| P-SETit.CLUS882664-1-1:1:2 | 41 | Cluster 882664-1 |
| P-SETit.Dzs-1:1:4 | 47 | Delta zein storage protein |
| P-SETit.Dzs-1:1:5 | 48 | Delta zein storage protein |
| P-SETit.EST CLUS675389-2-1:1:2 | 50 | Cluster 675389-2 |
| P-SETit.FM54-1:1:2 | 52 | Cluster 1102871_1 |

TABLE 16-continued

Transcriptional regulatory element groups (EXP), Promoters (P), leaders (L) and introns (I) identified using expression analysis.

| Annotation | SEQ ID NO: | Description |
|---|---|---|
| P-SETit.FM63-1:1:2 | 53 | Cluster 1019870_1 |
| P-SETit.Pro1-1:1:2 | 77 | Prolamin |
| P-SETit.Pro2-1:1:3 | 78 | Prolamin |
| P-SETit.Ssp1-1:1:1 | 93 | Seed storage protein |
| P-SETit.Ssp1-1:1:2 | 94 | Seed storage protein |
| P-SETit.Ubq5-1:1:2 | 104 | Ubiquitin 5 |
| L-SETit.Alc1-1:1:1 | 110 | Alpha-coixin |
| L-SETit.Alc2-1:1:1 | 111 | Alpha-coixin |
| L-SETit.CLUS1164825-1-1:1:1 | 118 | Cluster 1164825-1 |
| L-SETit.CLUS120796-1-1:1:1 | 119 | Cluster 120796-1 |
| L-SETit.CLUS120796-1-1:1:2 | 120 | Cluster 120796-1 |
| L-SETit.CLUS19108-1:1:1 | 121 | Cluster 19108 |
| L-SETit.CLUS19108-1:1:2 | 122 | Cluster 19108 |
| L-SETit.CLUS882664-1-1:1:1 | 123 | Cluster 882664-1 |
| L-SETit.Dzs-1:1:1 | 128 | Delta zein storage protein |
| L-SETit.EST CLUS675389-2-1:1:1 | 130 | Cluster 675389-2 |
| L-SETit.Pro1-1:1:1 | 151 | Prolamin |
| L-SETit.Pro2-1:1:2 | 152 | Prolamin |
| L-SETit.Ssp1-1:1:1 | 164 | Seed storage protein |
| L-SETit.Ubq5-1:1:1 | 170 | Ubiquitin 5 |
| I-SETit.CLUS120796-1-1:1:1 | 173 | Cluster 120796-1 |
| I-SETit.CLUS19108-1:1:1 | 174 | Cluster 19108 |
| I-SETit.Ubq5-1:1:2 | 178 | Ubiquitin 5 |

In some instances, the transcriptional start site could not be identified. The transcriptional regulatory elements, P-SETit.FM54-1:1:2 (SEQ ID NO: 52), P-SETit.FM63-1:1:2 (SEQ ID NO: 53) and P-SETit.CLUS1165324-1:1:1 (SEQ ID NO: 38) may be further comprised of a promoter element operably linked to a leader element or fragment of a leader element.

Example 8

Analysis of Seed Regulatory Elements Driving GUS in Bombarded Corn Tissues

Seed, root and leaf tissue isolated from corn plants is bombarded with plant GUS expression and control vectors to determine the capacity of transcriptional regulatory elements derived from *Setaria italica* to drive expression of a transgene, GUS.

Corn plant tissues were transformed with the plant GUS expression constructs using particle bombardment, listed in Table 17, below. Regulatory elements presented in example 7 were cloned into a base plant expression vector using standard methods known in the art. The resulting plant expression vectors contained a right border region from *Agrobacterium tumefaciens*, a first transgene cassette to test the regulatory or chimeric regulatory element comprised of, a regulatory or chimeric regulatory element, operably linked to an intron derived from the HSP70 heat shock protein of Zea mays (I-Zm.DnaK-1:1:1, SEQ ID NO: 1102), operably linked to a coding sequence for β-glucuronidase (GUS) that possessed a processable intron (GUS-2, SEQ ID NO: 1091), operably linked to the 3' termination region from the rice lipid transfer protein gene (T-Os.LTP-1:1:1, SEQ ID NO: 1089); a second transgene selection cassette used for selection of transformed plant cells that conferred resistance to the herbicide glyphosate (driven by the rice Actin 1 transcriptional regulatory element group, SEQ ID NO: 1098), and a left border region from A. tumefaciens. The resulting plasmids, pMON117992, pMON117993, pMON117994, pMON117995, pMON117996, pMON117997, pMON117998, pMON117999, pMON130551, pMON140500, pMON140501, pMON140502, pMON140503, pMON140504, pMON140505, pMON140506, pMON140507 and pMON140508 are used to transform corn plant tissue using particle bombardment.

TABLE 17

Binary plant transformation constructs and regulatory elements.

| Construct | Regulatory Elements | Reference Cluster |
|---|---|---|
| pMON117992 | P-SETit.EST CLUS675389-2-1:1:2 (SEQ ID NO: 50) L-SETit.EST CLUS675389-2-1:1:1 (SEQ ID NO: 130) | SETIT-28Jul09-CLUS675389_2 |
| pMON117993 | P-SETit.Pro1-1:1:2 (SEQ ID NO: 77) L-SETit.Pro1-1:1:1 (SEQ ID NO: 151) | SETIT-28Jul09-CLUS674121_1 |
| pMON117994 | P-SETit.Pro2-1:1:3 (SEQ ID NO: 78) L-SETit.Pro2-1:1:2 (SEQ ID NO: 152) | SETIT-28Jul09-CLUS681682_1 |
| pMON117995 | P-SETit.CLUS882664-1-1:1:2 (SEQ ID NO: 41) L-SETit.CLUS882664-1-1:1:1 (SEQ ID NO: 123) | SETIT-28Jul09-CLUS882664_1 |
| pMON117996 | EXP-SETit.CLUS19108 (SEQ ID NO: 13) P-SETit.CLUS19108-1:1:2 (SEQ ID NO: 40) L-SETit.CLUS19108-1:1:2 (SEQ ID NO: 122) I-SETit.CLUS19108-1:1:1 (SEQ ID NO: 174) L-SETit.CLUS19108-1:1:1 (SEQ ID NO: 121) | SETIT-28Jul09-CLUS19108_-4 |
| pMON117997 | P-SETit.Alc1-1:1:1 (SEQ ID NO: 28) L-SETit.Alc1-1:1:1 (SEQ ID NO: 110) | SETIT-28Jul09-CLUS675196_-2 |
| pMON117998 | P-SETit.Alc2-1:1:2 (SEQ ID NO: 30) L-SETit.Alc2-1:1:1 (SEQ ID NO: 111) | SETIT-28Jul09-CLUS675787_1 |
| pMON117999 | P-SETit.Dzs-1:1:4 (SEQ ID NO: 47) L-SETit.Dzs-1:1:1 (SEQ ID NO: 128) | SETIT-28Jul09-CLUS719393_1 |
| pMON130551 | P-SETit.Alc1-1:1:2 (SEQ ID NO: 29) L-SETit.Alc1-1:1:1 (SEQ ID NO: 110) | SETIT-28Jul09-CLUS675196_-2 |
| pMON140500 | P-SETit.Dzs-1:1:5 (SEQ ID NO: 48) L-SETit.Dzs-1.1:1 (SEQ ID NO: 128) | SETIT-28Jul09-CLUS719393_1 |
| pMON140501 | P-SETit.Ssp1-1:1:1 (SEQ ID NO: 93) L-SETit.Ssp1-1:1:1 (SEQ ID NO: 164) | SETIT-28Jul09-CLUS1194621_1 |
| pMON140502 | P-SETit.Ssp1-1:1:2 (SEQ ID NO: 94) L-SETit.Ssp1-1:1:1 (SEQ ID NO: 164) | SETIT-28Jul09-CLUS1194621_1 |
| pMON140503 | EXP-SETit.CLUS120796-1 (SEQ ID NO: 12) P-SETit.CLUS120796-1-1:1:1 (SEQ ID NO: 39) L-SETit.CLUS120796-1-1:1:2 (SEQ ID NO: 120) I-SETit.CLUS120796-1-1:1:1 (SEQ ID NO: 173) L-SETit.CLUS120796-1-1:1:1 (SEQ ID NO: 119) | SETIT-28Jul09-CLUS2300_3 |
| pMON140504 | P-SETit.CLUS1164825-1-1:1:1 (SEQ ID NO: 37) L-SETit.CLUS1164825-1-1:1:1 (SEQ ID NO: 118) | SETIT-28Jul09-CLUS1164825_1 |
| pMON140505 | EXP-SETit.Ubq5 (SEQ ID NO: 22) P-SETit.Ubq5-1:1:2 (SEQ ID NO: 104) L-SETit.Ubq5-1:1:1 (SEQ ID NO: 170) I-SETit.Ubq5-1:1:2 (SEQ ID NO: 178) | SETIT-28Jul09-CLUS12299_7 |
| pMON140506 | P-SETit.FM54-1:1:2 (SEQ ID NO: 52) | SETIT-28Jul09-CLUS1102871_1 |
| pMON140507 | P-SETit.FM63-1:1:2 (SEQ ID NO: 53) | SETIT-28Jul09-CLUS1019870_1 |
| pMON140508 | P-SETit.CLUS1165324-1:1:1 (SEQ ID NO: 38) | SETIT-28Jul09-CLUS1165324_1 |

The plant transformation vector, pMON117992 is comprised of the promoter element, P-SETit.EST CLUS675389-2-1:1:2 (SEQ ID NO: 50), operably linked 5' to the leader element, L-SETit.EST CLUS675389-2-1:1:1 (SEQ ID NO:130). The plant transformation vector, pMON117993 is comprised of the promoter element, P-SETit.Pro1-1:1:2 (SEQ ID NO: 77), operably linked 5' to the leader element, L-SETit.Pro1-1:1:1 (SEQ ID NO: 151). The plant transformation vector, pMON117994 is comprised of the promoter element, P-SETit.Pro2-1:1:3 (SEQ ID NO: 78), operably linked 5' to the leader element, L-SETit.Pro2-1:1:2 (SEQ ID NO: 152). The plant transformation vector, pMON117995 is comprised of the promoter element, P-SETit.CLUS882664-1-1:1:2 (SEQ ID NO: 41), operably linked 5' to the leader element, L-SETit.CLUS882664-1-1:1:1 (SEQ ID NO: 123). The plant transformation vector, pMON117996 is comprised of the transcriptional regulatory element group, EXP-SETit.CLUS19108 (SEQ ID NO: 13), which is further comprised of the promoter element, P-SETit.CLUS19108-1:1:2 (SEQ ID NO: 40), operably linked 5' to the leader element, L-SETit.CLUS19108-1:1:2 (SEQ ID NO: 122), operably linked 5' to the intron element, I-SETit.CLUS19108-1:1:1 (SEQ ID NO: 174), operably linked 5' to the leader element, L-SETit.CLUS19108-1:1:1 (SEQ ID NO: 121). The plant transformation vector, pMON117997 is comprised of the promoter element, P-SETit.Alc1-1:1:1 (SEQ ID NO: 28), operably linked 5' to the leader element, L-SETit.Alc1-1:1:1 (SEQ ID NO: 110). The plant transformation vector, pMON117998 is comprised of the promoter element, P-SETit.Alc2-1:1:2 (SEQ ID NO: 30), operably linked 5' to the leader element, L-SETit.Alc2-1:1:1 (SEQ ID NO: 111). The plant transformation vector, pMON117999 is comprised of the promoter element, P-SETit.Dzs-1:1:4 (SEQ ID NO: 47), operably linked 5' to the leader element, L-SETit.Dzs-1:1:1 (SEQ ID NO: 128). The plant transformation vector, pMON130551 is comprised of the promoter element, P-SETit.Alc1-1:1:2 (SEQ ID NO: 29), operably linked 5' to the leader element, L-SETit.Alc1-1:1:1 (SEQ ID NO: 110). The plant transformation vector, pMON140500 is comprised of the promoter element, P-SETit.Dzs-1:1:5 (SEQ ID NO: 48), operably linked 5' to the leader element, L-SETit.Dzs-1:1:1 (SEQ ID NO: 128). The plant transformation vector, pMON140501 is comprised of the promoter element, P-SETit.Ssp1-1:1:1 (SEQ ID NO: 93), operably linked 5' to the leader element, L-SETit.Ssp1-1:1:1 (SEQ ID NO: 164). The plant transformation vector, pMON140502 is comprised of the promoter element, P-SETit.Ssp1-1:1:2 (SEQ ID NO: 94), operably linked 5' to the leader element, L-SETit.Ssp1-1:1:1 (SEQ ID NO: 164). The plant transformation vector, pMON140503 is comprised of the transcriptional regulatory element group, EXP-SETit.CLUS120796-1 (SEQ ID NO: 12), which is further comprised of the promoter element, P-SETit.CLUS120796-1-1:1:1 (SEQ ID NO: 39), operably linked 5' to the leader element, L-SETit.CLUS120796-1-1:1:2 (SEQ ID NO: 120), operably linked 5' to the intron element, I-SETit.CLUS120796-1-1:1:1 (SEQ ID NO: 173), operably linked 5' to the leader element, L-SETit.CLUS120796-1-1:1:1 (SEQ ID NO: 119). The plant transformation vector, pMON140504 is comprised of the promoter element, P-SETit.CLUS1164825-1-1:1:1 (SEQ ID NO: 37), operably linked 5' to the leader element, L-SETit.CLUS1164825-1-1:1:1 (SEQ ID NO: 118). The plant transformation vector, pMON140505 is comprised of the transcriptional regulatory element group, EXP-SETit.Ubq5 (SEQ ID NO: 22), which is further comprised of the promoter element, P-SETit.Ubq5-1:1:2 (SEQ ID NO: 104), operably linked 5' to the leader element, L-SETit.Ubq5-1:1:1 (SEQ ID NO: 170), operably linked 5' to the intron element, I-SETit.Ubq5-1:1:2 (SEQ ID NO: 178). The plant transformation vector, pMON140506 is comprised of the promoter element, P-SETit.FM54-1:1:2 (SEQ ID NO: 52). The plant transformation vector, pMON140507 is comprised of the promoter element, P-SETit.FM63-1:1:2 (SEQ ID NO: 53). The plant transformation vector, pMON140508 is comprised of the promoter element, P-SETit.CLUS1165324-1:1:1 (SEQ ID NO: 38).

Corn plant tissues are transformed using particle bombardment methods and LH244 corn seeds as outlined in Example 3 above. The bombarded root and leaf tissues are allowed to incubate in the dark for 24 hours at 26° C. Following this overnight incubation, the tissues are stained in solution for GUS expression overnight at 37 degrees Celsius. After staining overnight, the tissues are soaked in 70% ethanol overnight to remove chlorophyll and reveal the GUS staining. The tissues are then photographed and a rating scale of "0" to "4" reflecting the level of GUS expression is assigned to each construct.

Expression of the GUS transgene demonstrated in each tissue is used to infer the relative potential level and specificity of each element's capacity to drive transgene expression in stably transformed corn plants. Average GUS expression ratings are provided in Table 18 below.

TABLE 18

GUS expression ratings for particle bombardment assay of potential seed promoters.

| Construct | Regulatory Elements | Embryo | Endosperm | Root | Leaf |
| --- | --- | --- | --- | --- | --- |
| pMON117992 | P-SETit.EST CLUS675389-2-1:1:2 (SEQ ID NO: 50) L-SETit.EST CLUS675389-2-1:1:1 (SEQ ID NO: 130) | 1 | 1 | 1 | 0 |
| pMON117993 | P-SETit.Pro1-1:1:2 (SEQ ID NO: 77) L-SETit.Pro1-1:1:1 (SEQ ID NO: 151) | 1 | 3 | 1 | 0 |
| pMON117994 | P-SETit.Pro2-1:1:3 (SEQ ID NO: 78) L-SETit.Pro2-1:1:2 (SEQ ID NO: 152) | 1 | 3 | 1 | 0 |
| pMON117995 | P-SETit.CLUS882664-1-1:1:2 (SEQ ID NO: 41) L-SETit.CLUS882664-1-1:1:1 (SEQ ID NO: 123) | 0 | 0 | 1 | 0 |

TABLE 18-continued

GUS expression ratings for particle bombardment assay of potential seed promoters.

| Construct | Regulatory Elements | Embryo | Endosperm | Root | Leaf |
|---|---|---|---|---|---|
| pMON117996 | EXP-SETit.CLUS19108 (SEQ ID NO: 13)<br>P-SETit.CLUS19108-1:1:2 (SEQ ID NO: 40)<br>L-SETit.CLUS19108-1:1:2 (SEQ ID NO: 122)<br>I-SETit.CLUS19108-1:1:1 (SEQ ID NO: 174)<br>L-SETit.CLUS19108-1:1:1 (SEQ ID NO: 121) | 3 | 3 | 2 | 0 |
| pMON117997 | P-SETit.Alc1-1:1:1 (SEQ ID NO: 28)<br>L-SETit.Alc1-1:1:1 (SEQ ID NO: 110) | 1 | 4 | 1 | 0 |
| pMON117998 | P-SETit.Alc2-1:1:2 (SEQ ID NO: 30)<br>L-SETit.Alc2-1:1:1 (SEQ ID NO: 111) | 0 | 3 | 1 | 0 |
| pMON117999 | P-SETit.Dzs-1:1:4 (SEQ ID NO: 47)<br>L-SETit.Dzs-1:1:1 (SEQ ID NO: 128) | 2 | 3 | 2 | 0 |
| pMON130551 | P-SETit.Alc1-1:1:2 (SEQ ID NO: 29)<br>L-SETit.Alc1-1:1:1 (SEQ ID NO: 110) | 1 | 2 | 1 | 0 |
| pMON140500 | P-SETit.Dzs-1:1:5 (SEQ ID NO: 48)<br>L-SETit.Dzs-1:1:1 (SEQ ID NO: 128) | 0 | 3 | 3 | 0 |
| pMON140501 | P-SETit.Ssp1-1:1:1 (SEQ ID NO: 93)<br>L-SETit.Ssp1-1:1:1 (SEQ ID NO: 164) | 0 | 2 | 1 | 0 |
| pMON140502 | P-SETit.Ssp1-1:1:2 (SEQ ID NO: 94)<br>L-SETit.Ssp1-1:1:1 (SEQ ID NO: 164) | 0 | 3 | 1 | 0 |
| pMON140503 | EXP-SETit.CLUS120796-1 (SEQ ID NO: 12)<br>P-SETit.CLUS120796-1-1:1:1 (SEQ ID NO: 39)<br>L-SETit.CLUS120796-1-1:1:2 (SEQ ID NO: 120)<br>I-SETit.CLUS120796-1-1:1:1 (SEQ ID NO: 173)<br>L-SETit.CLUS120796-1-1:1:1 (SEQ ID NO: 119) | 1 | 0 | 2 | 0 |
| pMON140504 | P-SETit.CLUS1164825-1-1:1:1 (SEQ ID NO: 37)<br>L-SETit.CLUS1164825-1-1:1:1 (SEQ ID NO: 118) | 0 | 0 | 1 | 0 |
| pMON140505 | EXP-SETit.Ubq5 (SEQ ID NO: 22)<br>P-SETit.Ubq5-1:1:2 (SEQ ID NO: 104)<br>L-SETit.Ubq5-1:1:1 (SEQ ID NO: 170)<br>I-SETit.Ubq5-1:1:2 (SEQ ID NO: 178) | 4 | 5 | 4 | 4 |
| pMON140506 | P-SETit.FM54-1:1:2 (SEQ ID NO: 52) | 1 | 0 | 1 | 0 |
| pMON140507 | P-SETit.FM63-1:1:2 (SEQ ID NO: 53) | 1 | 0 | 2 | 0 |
| pMON140508 | P-SETit.CLUS1165324-1:1:1 (SEQ ID NO: 38) | 0 | 0 | 1 | 0 |

In all cases, some transgene expression was observed in tissues bombarded with the construct shown above in Table 18. Highest levels of expression in the seed were observed for the tissues bombarded with the constructs, pMON117996 ((EXP-SETit.CLUS19108 (SEQ ID NO: 13) comprised of P-SETit.CLUS19108-1:1:2 (SEQ ID NO: 40)+L-SETit.CLUS19108-1:1:2 (SEQ ID NO: 122)+I-SETit.CLUS19108-1:1:1 (SEQ ID NO: 174)+L-SETit.CLUS19108-1:1:1 (SEQ ID NO: 121)) and pMON140505 ((EXP-SETit.Ubq5 (SEQ ID NO: 22) comprised of P-SETit.Ubq5-1:1:2 (SEQ ID NO: 104)+L-SETit.Ubq5-1:1:1 (SEQ ID NO: 170)+I-SETit.Ubq5-1:1:2 (SEQ ID NO: 178)). Surprisingly, the construct pMON140505 ((EXP-SETit.Ubq5 (SEQ ID NO: 22) comprised of P-SETit.Ubq5-1:1:2 (SEQ ID NO: 104)+L-SETit.Ubq5-1:1:1 (SEQ ID NO: 170)+I-SETit.Ubq5-1:1:2 (SEQ ID NO: 178)) demonstrated high levels of constitutive expression which had not been initially predicted by the EST counts provided in Table 15 of example 7. Some constructs such as, pMON117998 (P-SETit.Alc2-1:1:2 (SEQ ID NO: 30)+L-SETit.Alc2-1:1:1 (SEQ ID NO: 111)); pMON140500 (P-SETit.Dzs-1:1:5 (SEQ ID NO: 48)+L-SETit.Dzs-1:1:1 (SEQ ID NO: 128)); pMON140501 (P-SETit.Ssp1-1:1:1 (SEQ ID NO: 93)+L-SETit.Ssp1-1:1:1 (SEQ ID NO: 164) and pMON140502 (P-SETit.Ssp1-1:1:2 (SEQ ID NO: 94)+L-SETit.Ssp1-1:1:1 (SEQ ID NO: 164)), demonstrated expression in the endosperm and not the embryo. In addition, while the construct, pMON140500 (P-SETit.Dzs-1:1:5 (SEQ ID NO: 48)+L-SETit.Dzs-1:1:1 (SEQ ID NO: 128)) demonstrated expression in only the endosperm, the construct, pMON117999 (P-SETit.Dzs-1:1:4 (SEQ ID NO: 47)+L-SETit.Dzs-1:1:1 (SEQ ID NO: 128)), which is comprised of a longer version of the Dzs promoter, (P-SETit.Dzs-1:1:5 (SEQ ID NO: 48)), demonstrated expression in both endosperm and embryo, suggesting the potential for an embryo enhancer comprising the fragment deleted from P-SETit.Dzs-1:1:4 (SEQ ID NO: 47) to produce P-SETit-.Dzs-1:1:5 (SEQ ID NO: 48).

Example 9

Regulatory Elements Driving GUS Transgene Expression in Transgenic Corn or Wheat Corn or wheat plants are transformed with constructs comprising regulatory elements such as the transcriptional regulatory element groups, provided as SEQ ID NOS: 1 through 22; or the promoters provided as SEQ ID NOS: 23 through 105 and SEQ ID NOS: 353 through 536, operably linked to any of the leaders provided as SEQ ID NOS: 106 through 171 and 537 through 588. The transcriptional regulatory element groups or promoters can be operably linked to a marker transgene such as GUS similar to that as described in example 2 above. In addition, intron elements such as those provided as SEQ ID NOS: 172 through 267 and SEQ ID NOS: 317 through 323 and SEQ ID NOS: 589 through 778 can be operably linked between the expression elements and transgene of interest to improve expression or modulate the expression of the transgene within the transformed plant. The plants are transformed using agrobacterium or particle bombardment methods known in the art. Transformants containing one or two copies of the transgene cassette are selected using methods known in the art. Transformants are then assayed to determine the level of expression of the marker transgene in various tissues of the plant similar to that as described in example 2. F1 progeny are produced by either outcrossing the transformed event with an untransformed event, or through self-fertilization. The F1 progeny are grown and expression of the marker transgene is determined using progeny possessing one or two copies of the transgene cassette. Chimeric regulatory elements comprised of any of the promoters, leader and introns presented above are selected based upon the level of expression and tissue specificity of expression to drive transgenes of agronomic or commercial importance.

Example 10

Enhancers Derived from the Regulatory Elements

Enhancers are derived from the promoter elements presented as SEQ ID NOS: 23 through 105 and SEQ ID NOS: 353 through 536. The enhancer element may be comprised of one or more cis regulatory elements that when operably linked 5' or 3' to a promoter element, or operably linked 5' or 3' to additional enhancer elements that are operably linked to a promoter, can enhance or modulate expression of a transgene, or provide expression of a transgene in a specific cell type or plant organ or at a particular time point in development or circadian rhythm. Enhancers are made by removing the TATA box or functionally similar elements and any downstream sequence from the promoters that allow transcription to be initiated from the promoters presented as SEQ ID NOS: 23 through 105 and SEQ ID NOS: 353 through 536 or fragments thereof, in which the TATA box or functionally similar elements and sequence downstream of the TATA box are removed.

Enhancer elements are derived from the promoter elements presented as SEQ ID NOS: 23 through 105 and SEQ ID NOS: 353 through 536 and cloned using methods known in the art to be operably linked 5' or 3' to a promoter element, or operably linked 5' or 3' to additional enhancer elements that are operably linked to a promoter. Alternatively, enhancer elements are cloned using methods known in the art to be operably linked to one or more copies of the enhancer element which are operably linked 5' or 3' to a promoter element, or operably linked 5' or 3' to additional enhancer elements that are operably linked to a promoter. Enhancer elements can also be cloned using methods known in the art to be operably linked 5' or 3' to a promoter element derived from a different genus organism, or operably linked 5' or 3' to additional enhancer elements derived from other genus organisms or the same genus organism that are operably linked to a promoter derived from either the same or different genus organism, resulting in a chimeric regulatory element. A GUS expression plant transformation vector is constructed using methods known in the art similar to the constructs described in the previous examples in which the resulting plant expression vectors contains a right border region from *A. tumefaciens*, a first transgene cassette to test the regulatory or a chimeric regulatory element comprised of, a regulatory or chimeric regulatory element, operably linked to an intron derived from the HSP70 heat shock protein of *Zea mays* or any of the introns presented as SEQ ID NOS: 172 through 267 and SEQ ID NOS: 317 through 323 and SEQ ID NOS: 589 through 778 or any other intron, operably linked to a coding sequence for β-glucuronidase (GUS) that either possesses a processable intron (GUS-2, SEQ ID NO: 1091) or no intron (GUS-1, SEQ ID NO: 1090), operably linked to the Nopaline synthase 3' termination region from *A. tumefaciens* (T-AGRtu.nos-1:1:13, SEQ ID NO: 1088) or the 3' termination region from the rice lipid transfer protein gene (T-Os.LTP-1:1:1, SEQ ID NO: 1089); a second transgene selection cassette used for selection of transformed plant cells that confers resistance to the herbicide glyphosate (driven by the rice Actin 1 promoter), or alternatively, the antibiotic kanamycin (driven by the rice Actin 1 promoter) and a left border region from *A. tumefaciens*. The resulting plasmids are used to transform corn plants or other genus plants by the methods described above or by other *Agrobacterium*-mediated or particle bombardment methods known in the art. Alternatively, protoplast cells derived from corn or other genus plants are transformed using methods known in the art to perform transient assays GUS expression driven by the test regulatory element comprising one or more enhancers is evaluated in stable or transient plant assays to determine the effects of the enhancer element on expression of a transgene. Modifications to one or more enhancer elements or duplication of one or more enhancer elements is performed based upon empirical experimentation and the resulting gene expression regulation that is observed using each regulatory element composition. Altering the relative positions of one or more enhancers in the resulting regulatory or chimeric regulatory element may affect the transcriptional activity or specificity of the regulatory or chimeric regulatory element and is determined empirically to identify the best enhancers for the desired transgene expression profile within the corn plant or other genus plant.

Example 11

Analysis of Intron-Mediated Enhancement of GUS Activity Using Plant Derived Protoplasts The introduction of a foreign gene into a new plant host does not always result in a high expression of the incoming gene. Furthermore, if dealing with complex traits, it is sometimes necessary to modulate several genes with spatially or temporarily different expression pattern. Introns can principally provide such modulation. However multiple use of the same intron in one plant has shown to exhibit disadvantages. In those cases it is necessary to have a collection of basic control elements for the construction of appropriate recombinant DNA elements. However, the available collection of introns with expression enhancing properties is limited and alternatives are needed.

In plants, the inclusion of some introns in gene constructs leads to increased mRNA and protein accumulation relative to constructs lacking the intron. This effect has been termed "intron mediated enhancement" (IME) of gene expression (Mascarenhas et al., (1990) *Plant Mol. Biol.* 15:913-920). Introns known to stimulate expression in plants have been identified in maize genes (e.g. tubA1, Adh1, Sh1, Ubi1 (Jeon et al. (2000) *Plant Physiol.* 123:1005-1014; Callis et al. (1987) *Genes Dev.* 1:1183-1200; Vasil et al. (1989) *Plant Physiol.* 91:1575-1579; Christiansen et al. (1992) *Plant Mol. Biol.* 18:675-689) and in rice genes (e.g. salt, tpi: McElroy et al., *Plant Cell* 2:163-171 (1990); Xu et al., *Plant Physiol.* 106:459-467 (1994)). Similarly, introns from dicotyledonous plant genes like those from petunia (e.g. rbcS), potato (e.g. st-ls1) and from *Arabidopsis thaliana* (e.g. ubq3 and pat1) have been found to elevate gene expression rates (Dean et al. (1989) *Plant Cell* 1:201-208; Leon et al. (1991) *Plant Physiol.* 95:968-972; Norris et al. (1993) *Plant Mol Biol* 21:895-906; Rose and Last (1997) *Plant J.* 11:455-464). It has been shown that deletions or mutations within the splice sites of an intron reduce gene expression, indicating that splicing might be needed for IME (Mascarenhas et al. (1990) *Plant Mol Biol.* 15:913-920; Clancy and Hannah (2002) *Plant Physiol.* 130:918-929). However, that splicing per se is not required for a certain IME in dicotyledonous plants has been shown by point mutations within the splice sites of the pat1 gene from *A. thaliana* (Rose and Beliakoff (2000) *Plant Physiol.* 122:535-542).

Enhancement of gene expression by introns is not a general phenomenon because some intron insertions into recombinant expression cassettes fail to enhance expression (e.g. introns from dicot genes (rbcS gene from pea, phaseolin gene from bean and the stls-1 gene from *Solanum tuberosum*) and introns from maize genes (adh1 gene the ninth intron, hsp81 gene the first intron)) (Chee et al. (1986) *Gene* 41:47-57; Kuhlemeier et al. (1988) *Mol Gen Genet* 212:405-411; Mascarenhas et al. (1990) *Plant Mol. Biol.* 15:913-920; Sinibaldi and Mettler (1992) In W E Cohn, K Moldave, eds, *Progress in Nucleic Acid Research and Molecular Biology*, Vol 42. Academic Press, New York, pp 229-257; Vancanneyt et al. 1990 *Mol. Gen. Genet.* 220:245-250). Therefore, not each intron can be employed in order to manipulate the gene expression level of non-endogenous genes or endogenous genes in transgenic plants. What characteristics or specific sequence features must be present in an intron sequence in order to enhance the expression rate of a given gene is not known in the prior art and therefore from the prior art it is not possible to predict whether a given plant intron, when used heterologously, will cause IME.

An intron is selected based upon experimentation and comparison with an intronless expression vector control to empirically select an intron and configuration within the vector T-DNA element arrangement for optimal expression of a transgene. For example, in the expression of an herbicide resistance gene, such as CP4 which confers resistance to the herbicide glyphosate, it is desirable to have transgene expression within the reproductive tissues as well as the vegetative tissues, to prevent the loss of yield when applying the herbicide. An intron in this instance would be selected upon its ability when operably linked to a constitutive promoter, to enhance expression of the herbicide resistance conferring transgene, particularly within the reproductive cells and tissues of the transgenic plant and thus providing both vegetative and reproductive tolerance to the transgenic plant, when sprayed with the herbicide (see for example International Patent Application, WO2007/098042A2).

Introns presented as SEQ ID NOS: 16 through 306 are identified using genomic DNA contigs in comparison to expressed sequence tag clusters or cDNA contigs to identify exon and intron sequences within the genomic DNA. In addition, 5' UTR or leader sequences are also used to define the intron/exon splice junction of one or more introns under conditions when the gene sequence encodes a leader sequence that is interrupted by one or more introns. Introns presented as SEQ ID NOS: 172 through 267 and SEQ ID NOS: 317 through 323 and SEQ ID NOS: 589 through 778 are cloned using methods known in the art into a plant transformation vector to be operably linked 3' to a transcriptional regulatory element and leader fragment and operably linked 5' to either a second leader fragment or to coding sequences as depicted in the two transgene cassettes presented in FIG. 15. A first possible transgene cassette (Transgene Cassette Configuration 1 in FIG. 15) is comprised of a promoter or chimeric promoter element [A], operably linked 5' to a leader element [B], operably linked 5' to a test intron element [C], operably linked to a coding region [D], which is operably linked to a 3' UTR element [E]. Alternatively, a second possible transgene cassette (Transgene Cassette Configuration 2 in FIG. 15) is comprised of a promoter or chimeric promoter element [F], operably linked 5' to a first leader element or first leader element fragment [G], operably linked 5' to a test intron element [H], operably linked 5' to a second leader element or first leader element second fragment [I], operably linked to a coding region [J], which is operably linked to a 3' UTR element [K].

The first 6 nucleotides on the 5' end and the last 6 nucleotides on the 3' end of the introns presented as SEQ ID NOS: 172 through 267 and SEQ ID NOS: 317 through 323 and SEQ ID NOS: 589 through 778 represent nucleotides before and after the intron/exon splice junction, respectively. These short 6 nucleotide sequences can be altered or modified by having additional sequence appended (i.e. native or artificial) to facilitate cloning of the intron into a plant transformation vector, so long as the seventh and eighth nucleotides from the 5' end (GT) and the seventh and eighth nucleotide from the 3' end (AG) of SEQ ID NOS: 172 through 267 and SEQ ID NOS: 317 through 323 and SEQ ID NOS: 589 through 778 are preserved, thus preserving the intron/exon splice junction of the intron. It is preferable to avoid using the nucleotide sequence TG or G just prior to the seventh and eighth nucleotides from the 5' end (GT) and the nucleotide sequence, A or AT from the seventh and eighth nucleotide from the 3' end (AG) to eliminate the potential of unwanted stop and start codons from being formed during processing of the messenger RNA into the final transcript.

The introns are assayed for the ability to enhance expression in transient assay or stable plant assay. For transient assay of intron mediated enhancement, a base plant vector is constructed using methods known in the art. The intron is cloned into a base plant vector which comprises an expression cassette comprised of a constitutive promoter such as the Cauliflower mosaic virus promoter, P-CaMV.35S-enh-1:1:9 (SEQ ID NO: 1096), operably linked 5' to a leader element, L-CaMV.35S-1:1:15 (SEQ ID NO: 1111), operably linked 5' to a test intron element (SEQ ID NOS: 172 through 267 and SEQ ID NOS: 317 through 323 and SEQ ID NOS: 589 through 778), operably linked to a coding sequence for β-glucuronidase (GUS) that either possesses a processable intron (GUS-2, SEQ ID NO: 1091) or no intron (GUS-1, SEQ ID NO: 1090), operably linked to the Nopaline synthase 3' termination region from *A. tumefaciens* (T-AGRtu.nos-1:1:13, SEQ ID NO: 1088). Protoplast cells derived from corn or other genus plant tissue is transformed with the base plant vector and assayed for activity. A comparison of activity is made using a control plasmid comprised of the same transgene cassette as the test plasmid, but without the test intron to see if the intron provides an intron mediated enhancement effect.

Two plasmids, for use in co-transformation and normalization of data, are also constructed using methods known in the art. Each plasmid contains a specific luciferase coding sequence which is driven by a constitutive transcriptional regulatory expression element group. The plant vector, pMON19437 is comprised of a transgene cassette comprised of a constitutive promoter (EXP-CaMV.35S-enh, SEQ ID NO: 1095), operably linked 5' to an intron, (I-Zm.DnaK-1:1:1, SEQ ID NO: 1102), operably linked 5' to a firefly (*Photinus pyralis*) luciferase coding sequence (LU-CIFERASE:1:3, SEQ ID NO: 1109), operably linked 5' to a 3' termination region from the *A. tumefaciens* nopaline synthase gene (T-AGRtu.nos-1:1:13, SEQ ID NO: 1088). The plant vector, pMON63934 is comprised of a transgene cassette comprised of a constitutive transcriptional regulatory expression element group, (EXP-CaMV.35S-enh-Lhcb1, SEQ ID NO: 1106), operably linked 5' to a sea pansy (*Renilla reniformis*) luciferase coding sequence (CR-Ren.hRenilla Lucife-0:0:1, SEQ ID NO: 1110), operably linked 5' to a 3' termination region from the *A. tumefaciens* nopaline synthase gene (T-AGRtu.nos-1:1:13, SEQ ID NO: 1088).

Corn leaf protoplasts or other genus plant protoplasts are transformed using a PEG-based transformation method, similar to those known in the art. Protoplast cells are transformed with a DNA prep comprised of equimolar quantities of the two luciferase expression plasmids, pMON19437 and pMON63934 and one of the test plasmids and incubated overnight in total darkness. After incubation, the cells are rinsed, resuspended and lysed. Measurements of both GUS and luciferase are conducted using aliquots of each lysis preparation. Essentially, the collected, transformed protoplast cells are lysed in 5× passive lysis buffer (Promega). After allowing for lysis, aliquots of the lysed preparation are placed into two different small-well trays. One tray is used for GUS measurements. For quantitative analysis of GUS expression, total protein is extracted from lysis preparation. One microgram of total protein is used with the fluorogenic substrate 4-methyleumbelliferyl-β-D-glucuronide (MUG) in a total reaction volume of 50 microliters. The reaction product, 4-methlyumbelliferone (4-MU), is maximally fluorescent at high pH, where the hydroxyl group is ionized. Addition of a basic solution of sodium carbonate simultaneously stops the assay and adjusts the pH for quantifying the fluorescent product. Fluorescence is measured with excitation at 365 nm, emission at 445 nm using a Fluoromax-3 with Micromax Reader, with slit width set at excitation 2 nm and emission 3 nm. GUS values are expressed as pmol of 4-MU protein per minute per milligram protein (pmol 4-MU $min^{-1}$ $mg^{-1}$ protein).

The second tray is used to perform a dual luciferase assay as outlined in Example 5 above. To compare the relative ability of the intron to enhance expression, GUS values are expressed as a ratio of GUS to luciferase activity and compared with those levels imparted by the constitutive promoter and a known intron standard such as that as the intron derived from the HSP70 heat shock protein of *Zea mays*, I-Zm.DnaK-1:1:1 (SEQ ID NO: 1102).

For stable plant assay of the introns presented as SEQ ID NOS: 172 through 267 and SEQ ID NOS: 317 through 323 and SEQ ID NOS: 589 through 778, a GUS expression plant transformation vector is constructed using methods known in the art similar to the constructs described in the previous examples in which the resulting plant expression vectors contains a right border region from *A. tumefaciens*, a first transgene cassette to test the intron comprised of a constitutive promoter such as the Cauliflower mosaic virus promoter, P-CaMV.35S-enh-1:1:9 (SEQ ID NO: 1096), operably linked 5' to a leader element, L-CaMV.35S-1:1:15 (SEQ ID NO: 1111), operably linked 5' to a test intron element (SEQ ID NOS: 16 through 306), operably linked to a coding sequence for β-glucuronidase (GUS) that either possesses a processable intron (GUS-2, SEQ ID NO: 1091) or no intron (GUS-1, SEQ ID NO: 1090), operably linked to the Nopaline synthase 3' termination region from *A. tumefaciens* (T-AGRtu.nos-1:1:13, SEQ ID NO: 1088); a second transgene selection cassette used for selection of transformed plant cells that confers resistance to the herbicide glyphosate (driven by the rice Actin 1 promoter), or alternatively, the antibiotic kanamycin (driven by the rice Actin 1 promoter) and a left border region from *A. tumefaciens*. The resulting plasmids are used to transform corn plants or other genus plants by the methods described above or by *Agrobacterium*-mediated methods known in the art. Single-copy or low copy number transformants are selected for comparison to single-copy or low copy number transformed plants, transformed with a plant transformation vector identical to the test vector but without the test intron to determine if the test intron provides an intron mediated enhancement effect.

Any of the introns presented as SEQ ID NOS: 172 through 267 and SEQ ID NOS: 317 through 323 and SEQ ID NOS: 589 through 778 can be modified in a number of ways, such as deleting fragments within the intron sequence which may reduce expression or duplication of fragments with the intron that may enhance expression. In addition, sequences within the intron that may affect the specificity of expression to either particular cells types or tissues and organs can be duplicated or altered or deleted to affect expression and patterns of expression of the transgene. In addition, the introns presented as SEQ ID NOS: 172 through 267 and SEQ ID NOS: 317 through 323 and SEQ ID NOS: 589 through 778 can be modified to remove any potential start codons (ATG) that may cause unintentional transcripts from being expressed from improperly spliced introns as different, longer or truncated proteins. Once the intron has been empirically tested, or it has been altered based upon experimentation, the intron is used to enhance expression of a transgene in stably transformed plants that can be of any genus monocot or dicot plant, so long as the intron provides enhancement of the transgene. The intron can also be used to enhance expression in other organisms, such as algae, fungi or animal cells, so long as the intron provides enhancement or attenuation or specificity of expression of the transgene to which it is operably linked.

Example 12

Plasmid Constructs Comprised of Transgene Cassettes for Analysis of Intron-Mediated Enhancement of GUS Transgene Activity Intron elements isolated from *Setaria italica* are cloned using methods known in the art into plasmid constructs comprising a constitutive promoter to test the effect of the intron on expression of a GUS transgene driven by a constitutive promoter.

The intron elements presented as SEQ ID NOS: 179 through 267 were cloned into plasmid constructs comprising a constitutive promoter, P-CaMV.35S-enh-1:1:13 (SEQ ID NO: 1112), operably linked 5' to a leader element, L-CaMV.35S-1:1:15 (SEQ ID NO: 1111), operably linked to a test intron element (SEQ ID NOS: 179 through 267), operably linked 5' to a GUS coding sequence, (GUS-1, SEQ ID NO: 1090), operably linked 5' to the Nopaline synthase 3' termination region from *A. tumefaciens* (T-AGRtu.nos-1:1:13, SEQ ID NO: 1088). The plasmid construct identifier along with each intron annotation is presented in Table 19 below.

TABLE 19

Plasmid constructs comprising transgene cassettes to evaluate intron-mediated enhancement of GUS transgene expression.

| Construct | Intron Annotation | Intron SEQ ID NO: |
|---|---|---|
| pMON138824 | I-SETit.14-3-3A-2-1:1:1 | 179 |
| pMON138826 | I-SETit.14-3-3A-3-1:1:2 | 180 |
| pMON138816 | I-SETit.14-3-3A-4-1:1:2 | 181 |
| pMON138813 | I-SETit.14-3-3A-5-1:1:2 | 182 |
| pMON138829 | I-SETit.14-3-3B-2-1:1:1 | 183 |
| pMON138830 | I-SETit.14-3-3B-3-1:1:2 | 184 |
| pMON138820 | I-SETit.14-3-3B-4-1:1:2 | 185 |
| pMON138821 | I-SETit.14-3-3B-5-1:1:2 | 186 |
| pMON138831 | I-SETit.14-3-3C-1-1:1:1 | 187 |
| pMON138823 | I-SETit.14-3-3C-2-1:1:1 | 188 |
| pMON138817 | I-SETit.14-3-3C-3-1:1:2 | 189 |
| pMON138832 | I-SETit.14-3-3C-4-1:1:2 | 190 |
| pMON138822 | I-SETit.14-3-3C-5-1:1:2 | 191 |
| pMON138825 | I-SETit.14-3-3D-1-1:1:2 | 192 |
| pMON138828 | I-SETit.14-3-3D-2-1:1:1 | 193 |
| pMON138814 | I-SETit.14-3-3D-3-1:1:2 | 194 |
| pMON138827 | I-SETit.14-3-3D-4-1:1:3 | 195 |
| pMON138843 | I-SETit.14-3-3D-5-1:1:2 | 196 |
| pMON138835 | I-SETit.14-3-3E-2-1:1:1 | 197 |
| pMON138836 | I-SETit.14-3-3E-3-1:1:2 | 198 |
| pMON138845 | I-SETit.14-3-3E-4-1:1:2 | 199 |
| pMON138841 | I-SETit.14-3-3E-5-1:1:2 | 200 |
| pMON138794 | I-SETit.40S-7S-1_1-1:1:2 | 201 |

TABLE 19-continued

Plasmid constructs comprising transgene cassettes to evaluate intron-mediated enhancement of GUS transgene expression.

| Construct | Intron Annotation | Intron SEQ ID NO: |
|---|---|---|
| pMON138792 | I-SETit.40S-7S-1_2-1:1:2 | 202 |
| pMON138791 | I-SETit.40S-7S-1_3-1:1:2 | 203 |
| pMON138788 | I-SETit.40S-7S-1_4-1:1:2 | 204 |
| pMON138798 | I-SETit.40S-7S-2_2-1:1:1 | 205 |
| pMON138802 | I-SETit.40S-7S-2_3-1:1:1 | 206 |
| pMON138807 | I-SETit.40S-7S-2_4-1:1:1 | 207 |
| pMON138809 | I-SETit.40S-7S-3_1-1:1:2 | 208 |
| pMON138810 | I-SETit.40S-7S-3_2-1:1:2 | 209 |
| pMON138800 | I-SETit.40S-7S-3_3-1:1:2 | 210 |
| pMON138837 | I-SETit.60S_L10A1-1-1:1:2 | 211 |
| pMON138847 | I-SETit.60S_L10A1-2-1:1:2 | 212 |
| pMON138840 | I-SETit.60S_L10A1-3-1:1:2 | 213 |
| pMON140752 | I-SETit.60S_L10A1-4-1:1:1 | 214 |
| pMON140750 | I-SETit.60S_L10A1-5-1:1:2 | 215 |
| pMON140758 | I-SETit.ASA2-3-1:1:2 | 216 |
| pMON140757 | I-SETit.ClpD-1-1:1:1 | 217 |
| pMON138783 | I-SETit.DnaJ_1-1:1:2 | 218 |
| pMON138848 | I-SETit.DnaJ3-2-1:1:2 | 219 |
| pMON138786 | I-SETit.eEF1g_1-1:1:2 | 220 |
| pMON138787 | I-SETit.eEF1g_4-1:1:3 | 221 |
| pMON138842 | I-SETit.eIF5A1-1-1:1:1 | 222 |
| pMON138833 | I-SETit.eIF5A1-2-1:1:2 | 223 |
| pMON138844 | I-SETit.eIF5A1-3-1:1:2 | 224 |
| pMON138834 | I-SETit.eIF5A1-4-1:1:2 | 225 |
| pMON140751 | I-SETit.eIF5A1-5-1:1:2 | 226 |
| pMON138838 | I-SETit.eIF5A2-1-1:1:2 | 227 |
| pMON138839 | I-SETit.eIF5A2-2-1:1:3 | 228 |
| pMON138846 | I-SETit.eIF5A2-3-1:1:2 | 229 |
| pMON138849 | I-SETit.eIF5A2-4-1:1:2 | 230 |
| pMON140756 | I-SETit.eIF5A2-5-1:1:2 | 231 |
| pMON140753 | I-SETit.eIF5A3-1-1:1:1 | 232 |
| pMON140769 | I-SETit.eIF5A3-2-1:1:2 | 233 |
| pMON140754 | I-SETit.eIF5A3-3-1:1:2 | 234 |
| pMON140760 | I-SETit.eIF5A3-4-1:1:2 | 235 |
| pMON140763 | I-SETit.eIF5A3-5-1:1:2 | 236 |
| pMON138808 | I-SETit.GAD_1-1:1:2 | 237 |
| pMON138819 | I-SETit.GAD_2-1:1:2 | 238 |
| pMON138815 | I-SETit.GAD_3-1:1:2 | 239 |
| pMON138818 | I-SETit.GAD_4-1:1:2 | 240 |
| pMON140765 | I-SETit.Grf1-3-1:1:1 | 241 |
| pMON138806 | I-SETit.GRP-1-1:1:1 | 242 |
| pMON140768 | I-SETit.LSm8-1-1:1:2 | 243 |
| pMON140767 | I-SETit.LSm8-2-1:1:1 | 244 |
| pMON140771 | I-SETit.LSm8-3-1:1:1 | 245 |
| pMON140762 | I-SETit.LSm8-4-1:1:2 | 246 |
| pMON138812 | I-SETit.PGK3_1-1:1:2 | 247 |
| pMON138804 | I-SETit.PGK3_2-1:1:1 | 248 |
| pMON138793 | I-SETit.PIP1_1_2-1:1:1 | 249 |
| pMON138797 | I-SETit.PIP1-1_1-1:1:1 | 250 |
| pMON138796 | I-SETit.PIP1-1_3-1:1:2 | 251 |
| pMON138785 | I-SETit.PIP1-4_3-1:1:2 | 252 |
| pMON138784 | I-SETit.PIP2-2_2-1:1:2 | 253 |
| pMON138789 | I-SETit.PIP2-2_3-1:1:2 | 254 |
| pMON138790 | I-SETit.PIP2-5_2-1:1:2 | 255 |
| pMON138795 | I-SETit.PIP2-5_3-1:1:2 | 256 |
| pMON140764 | I-SETit.Prx17-2-1:1:1 | 257 |
| pMON140766 | I-SETit.Prx3-1-1:1:2 | 258 |
| pMON140770 | I-SETit.SBD-1-1:1:2 | 259 |
| pMON140761 | I-SETit.SBD-2-1:1:1 | 260 |
| pMON140759 | I-SETit.SBD-3-1:1:2 | 261 |
| pMON138799 | I-SETit.TubA2_1-1:1:1 | 262 |
| pMON138801 | I-SETit.TubA2_2-1:1:1 | 263 |
| pMON138805 | I-SETit.TubA2_3-1:1:1 | 264 |
| pMON138811 | I-SETit.TubA3_1-1:1:1 | 265 |
| pMON138803 | I-SETit.TubA3_2-1:1:1 | 266 |
| pMON140755 | I-SETit.Wx1-1-1:1:2 | 267 |

Each plasmid was used as template for PCR amplification of the transgene cassette for use in protoplast assay as described below.

Example 13

Analysis of Intron-Mediated Enhancement of GUS Activity Using Corn Protoplasts Protoplast cells, derived from corn leaf tissue, are transformed with transgene cassettes in the form of PCR amplicons to determine the effect of each intron on the expression of the transgene, GUS, driven by a constitutive promoter and compared to introns known to have an enhancement effect on transgene expression.

The constructs described in example 12 above and presented in Table 19 of example 12 were used as template to generate PCR amplicons using methods known in the art comprising a constitutive promoter, P-CaMV.35S-enh-1:1:13 (SEQ ID NO: 1112), operably linked 5' to a leader element, L-CaMV.35S-1:1:15 (SEQ ID NO: 1111), operably linked to a test intron element (SEQ ID NOS: 179 through 267), operably linked 5' to a GUS coding sequence, (GUS-1, SEQ ID NO: 1090), operably linked 5' to the Nopaline synthase 3' termination region from *A. tumefaciens* (T-AGR-tu.nos-1:1:13, SEQ ID NO: 1088). In addition, amplicons, derived from control plasmids were also generated using the same amplification methods from the control plasmid constructs, pMON19469, pMON65328, pMON25455, pMON8677 and pMON33449. The transgene cassette of pMON19469 is comprised of the transcriptional regulatory element group, EXP-CaMV.35S-enh/1-Zm.DnaK-1:1:1 (SEQ ID NO: 1104) and provides a comparison of the constitutive promoter enhanced using the intron I-Zm.D-naK-1:1:1. The transgene cassette of pMON65328 is comprised of the transcriptional regulatory element group, EXP-CaMV.35S-enh-Lhcb1/I-Os.Act1-1:1:9 (SEQ ID NO: 1105) and provides a comparison of enhancement of the constitutive promoter using the intron, I-Os.Act1-1:1:9. The transgene cassette of pMON25455 is comprised of the transcriptional regulatory element group, EXP-Os.Act1:1:1 (SEQ ID NO: 1098) and provides a comparison of expression using the native promoter, leader and intron of the rice actin 1 gene. The transgene cassette of pMON8677 is comprised of the promoter, P-CaMV.35S-enh-1:1:9 (SEQ ID NO: 1096) operably linked to the GUS coding sequence and provides a comparison of expression with a constitutive promoter without an intron for enhancement. The transgene cassette of pMON33449 is comprised of a variant of the CaMV 35S promoter (P-E35S:1:52, SEQ ID NO: 1117) and provides an additional comparator lacking an intron.

Protoplast cells, derived from corn leaf tissue are transformed using PEG-based transformation methods known in the art. Briefly, each test and control construct is used to provide template for amplification of the transgene cassette comprising each construct. The resulting amplicon is size fractionated on an agarose gel and the amplicon DNA is excised from the gel. The amplicon DNA is extracted from the gel fragment using methods known in the art and quantified by spectrophotometry. Protoplast cells are transformed using PEG methods known in the art and using either 0.3 or 0.1 pico-moles of PCR amplicon DNA. Two to four replicates are performed for each transformation and the average expression imparted by each construct determined. The mean GUS expression observed for each construct derived amplicon is normalized with respect to expression observed for the amplicon derived from pMON19469 comprised of the intron element, I-Zm.DnaK-1:1:1 (SEQ ID NO: 1102). Tables 20 and 21 below show the normalized average GUS expression imparted amplicons derived from the constructs presented in table 19 of example 12 relative to the average GUS expression imparted to amplicons derived from the control plasmids described above using 0.3 and 0.1 pmol of amplicon, respectively.

TABLE 20

Intron-mediated enhancement of GUS expression in corn protoplasts relative to I-Zm.DnaK-1:1:1 (SEQ ID NO: 1102) using 0.3 pmol of amplicon DNA.

| Construct | Intron Annotation | Intron SEQ ID NO: | Mean | Std Deviation |
|---|---|---|---|---|
| pMON138842 | I-SETit.eIF5A1-1-1:1:1 | 222 | 3.19777 | 0.14472 |
| pMON140750 | I-SETit.60S__L10A1-5-1:1:2 | 215 | 2.73551 | 0.14472 |
| pMON138806 | I-SETit.GRP-1-1:1:1 | 242 | 2.24406 | 0.16711 |
| pMON140768 | I-SETit.LSm8-1-1:1:2 | 243 | 1.79949 | 0.14472 |
| pMON138847 | I-SETit.60S__L10A1-2-1:1:2 | 212 | 1.76055 | 0.14472 |
| pMON138805 | I-SETit.TubA2__3-1:1:1 | 264 | 1.6441 | 0.16711 |
| pMON138826 | I-SETit.14-3-3A-3-1:1:2 | 180 | 1.59333 | 0.14472 |
| pMON138844 | I-SETit.eIF5A1-3-1:1:2 | 224 | 1.51864 | 0.16711 |
| pMON138845 | I-SETit.14-3-3E-4-1:1:2 | 199 | 1.47841 | 0.14472 |
| pMON138785 | I-SETit.PIP1-4__3-1:1:2 | 252 | 1.45536 | 0.14472 |
| pMON138812 | I-SETit.PGK3__1-1:1:2 | 247 | 1.36129 | 0.14472 |
| pMON138809 | I-SETit.40S-7S-3__1-1:1:2 | 208 | 1.35665 | 0.14472 |
| pMON138796 | I-SETit.PIP1-1__3-1:1:2 | 251 | 1.30268 | 0.14472 |
| pMON140762 | I-SETit.LSm8-4-1:1:2 | 246 | 1.28583 | 0.14472 |
| pMON138839 | I-SETit.eIF5A2-2-1:1:3 | 228 | 1.26341 | 0.16711 |
| pMON138836 | I-SETit.14-3-3E-3-1:1:2 | 198 | 1.23008 | 0.14472 |
| pMON140767 | I-SETit.LSm8-2-1:1:1 | 244 | 1.22373 | 0.14472 |
| pMON138824 | I-SETit.14-3-3A-2-1:1:1 | 179 | 1.2226 | 0.16711 |
| pMON140754 | I-SETit.eIF5A3-3-1:1:2 | 234 | 1.22009 | 0.14472 |
| pMON138829 | I-SETit.14-3-3B-2-1:1:1 | 183 | 1.17955 | 0.14472 |
| pMON138827 | I-SETit.14-3-3D-4-1:1:3 | 195 | 1.15355 | 0.14472 |
| pMON138831 | I-SETit.14-3-3C-1-1:1:1 | 187 | 1.13972 | 0.20467 |
| pMON138817 | I-SETit.14-3-3C-3-1:1:2 | 189 | 1.09812 | 0.14472 |
| pMON138783 | I-SETit.DnaJ__1-1:1:2 | 218 | 1.08489 | 0.14472 |
| pMON140769 | I-SETit.eIF5A3-2-1:1:2 | 233 | 1.0434 | 0.14472 |

TABLE 20-continued

Intron-mediated enhancement of GUS expression in corn protoplasts relative to I-Zm.DnaK-1:1:1 (SEQ ID NO: 1102) using 0.3 pmol of amplicon DNA.

| Construct | Intron Annotation | Intron SEQ ID NO: | Mean | Std Deviation |
|---|---|---|---|---|
| pMON138792 | I-SETit.40S-7S-1__2-1:1:2 | 202 | 1.04308 | 0.16711 |
| pMON140760 | I-SETit.eIF5A3-4-1:1:2 | 235 | 1.04187 | 0.14472 |
| pMON140758 | I-SETit.ASA2-3-1:1:2 | 216 | 1.01034 | 0.14472 |
| pMON19469 | I-Zm.DnaK-1:1:1 | 1102 | 1 | 0.14472 |
| pMON140761 | I-SETit.SBD-2-1:1:1 | 260 | 0.99105 | 0.16711 |
| pMON138794 | I-SETit.40S-7S-1__1-1:1:2 | 201 | 0.98962 | 0.14472 |
| pMON138789 | I-SETit.PIP2-2__3-1:1:2 | 254 | 0.96195 | 0.14472 |
| pMON138791 | I-SETit.40S-7S-1__3-1:1:2 | 203 | 0.94544 | 0.14472 |
| pMON138830 | I-SETit.14-3-3B-3-1:1:2 | 184 | 0.92124 | 0.16711 |
| pMON140766 | I-SETit.Prx3-1-1:1:2 | 258 | 0.88915 | 0.14472 |
| pMON138803 | I-SETit.TubA3__2-1:1:1 | 266 | 0.83768 | 0.16711 |
| pMON138832 | I-SETit.14-3-3C-4-1:1:2 | 190 | 0.80355 | 0.14472 |
| pMON138848 | I-SETit.DnaJ3-2-1:1:2 | 219 | 0.7898 | 0.16711 |
| pMON138835 | I-SETit.14-3-3E-2-1:1:1 | 197 | 0.78927 | 0.14472 |
| pMON138834 | I-SETit.eIF5A1-4-1:1:2 | 225 | 0.77272 | 0.14472 |
| pMON138821 | I-SETit.14-3-3B-5-1:1:2 | 186 | 0.671 | 0.14472 |
| pMON138849 | I-SETit.eIF5A2-4-1:1:2 | 230 | 0.67063 | 0.14472 |
| pMON138786 | I-SETit.eEF1g__1-1:1:2 | 220 | 0.6574 | 0.16711 |
| pMON140756 | I-SETit.eIF5A2-5-1:1:2 | 231 | 0.6269 | 0.16711 |
| pMON65328 | I-Os.Act1-1:1:19 | 1113 | 0.58395 | 0.14472 |
| pMON138840 | I-SETit.60S__L10A1-3-1:1:2 | 213 | 0.57366 | 0.14472 |
| pMON138822 | I-SETit.14-3-3C-5-1:1:2 | 191 | 0.55845 | 0.14472 |
| pMON140757 | I-SETit.ClpD-1-1:1:1 | 217 | 0.53607 | 0.14472 |
| pMON140753 | I-SETit.eIF5A3-1-1:1:1 | 232 | 0.52545 | 0.14472 |
| pMON138820 | I-SETit.14-3-3B-4-1:1:2 | 185 | 0.52034 | 0.16711 |
| pMON138800 | I-SETit.40S-7S-3__3-1:1:2 | 210 | 0.51862 | 0.16711 |
| pMON138828 | I-SETit.14-3-3D-2-1:1:1 | 193 | 0.51592 | 0.14472 |
| pMON138813 | I-SETit.14-3-3A-5-1:1:2 | 182 | 0.51379 | 0.14472 |
| pMON138843 | I-SETit.14-3-3D-5-1:1:2 | 196 | 0.50543 | 0.14472 |
| pMON138825 | I-SETit.14-3-3D-1-1:1:2 | 192 | 0.48895 | 0.14472 |
| pMON138814 | I-SETit.14-3-3D-3-1:1:2 | 194 | 0.48519 | 0.14472 |
| pMON138818 | I-SETit.GAD__4-1:1:2 | 240 | 0.47986 | 0.14472 |
| pMON138811 | I-SETit.TubA3__1-1:1:1 | 265 | 0.47762 | 0.16711 |
| pMON138823 | I-SETit.14-3-3C-2-1:1:1 | 188 | 0.41543 | 0.14472 |
| pMON138837 | I-SETit.60S__L10A1-1-1:1:2 | 211 | 0.40991 | 0.14472 |
| pMON138846 | I-SETit.eIF5A2-3-1:1:2 | 229 | 0.40485 | 0.14472 |
| pMON140763 | I-SETit.eIF5A3-5-1:1:2 | 236 | 0.40131 | 0.14472 |
| pMON138838 | I-SETit.eIF5A2-1-1:1:2 | 227 | 0.37694 | 0.14472 |
| pMON138801 | I-SETit.TubA2__2-1:1:1 | 263 | 0.35386 | 0.14472 |
| pMON138804 | I-SETit.PGK3__2-1:1:1 | 248 | 0.35284 | 0.16711 |
| pMON140765 | I-SETit.Grf1-3-1:1:1 | 241 | 0.32325 | 0.16711 |
| pMON140755 | I-SETit.Wx1-1-1:1:2 | 267 | 0.31895 | 0.16711 |
| pMON138790 | I-SETit.PIP2-5__2-1:1:2 | 255 | 0.2957 | 0.16711 |
| pMON140770 | I-SETit.SBD-1-1:1:2 | 259 | 0.29309 | 0.14472 |
| pMON138784 | I-SETit.PIP2-2__2-1:1:2 | 253 | 0.29174 | 0.14472 |
| pMON138808 | I-SETit.GAD__1-1:1:2 | 237 | 0.2874 | 0.14472 |
| pMON138807 | I-SETit.40S-7S-2__4-1:1:1 | 207 | 0.27522 | 0.16711 |
| pMON138819 | I-SETit.GAD__2-1:1:2 | 238 | 0.27038 | 0.14472 |
| pMON138833 | I-SETit.eIF5A1-2-1:1:2 | 223 | 0.25147 | 0.14472 |
| pMON138795 | I-SETit.PIP2-5__3-1:1:2 | 256 | 0.24221 | 0.14472 |
| pMON138802 | I-SETit.40S-7S-2__3-1:1:1 | 206 | 0.23983 | 0.16711 |
| pMON25455 EXP-Os.Act1 (SEQ ID NO: 1098) | EXP-Os.Act1 | | 0.21736 | 0.16711 |
| pMON140759 | I-SETit.SBD-3-1:1:2 | 261 | 0.2172 | 0.16711 |
| pMON138787 | I-SETit.eEF1g__4-1:1:3 | 221 | 0.17568 | 0.14472 |
| pMON138810 | I-SETit.40S-7S-3__2-1:1:2 | 209 | 0.16997 | 0.14472 |
| pMON138816 | I-SETit.14-3-3A-4-1:1:2 | 181 | 0.16765 | 0.14472 |
| pMON138815 | I-SETit.GAD__3-1:1:2 | 239 | 0.16017 | 0.20467 |
| pMON138788 | I-SETit.40S-7S-1__4-1:1:2 | 204 | 0.15842 | 0.16711 |
| pMON140752 | I-SETit.60S__L10A1-4-1:1:1 | 214 | 0.15302 | 0.14472 |
| pMON140751 | I-SETit.eIF5A1-5-1:1:2 | 226 | 0.14712 | 0.14472 |
| pMON138841 | I-SETit.14-3-3E-5-1:1:2 | 200 | 0.14157 | 0.14472 |
| pMON8677 | No intron | | 0.14109 | 0.14472 |
| pMON138798 | I-SETit.40S-7S-2__2-1:1:1 | 205 | 0.11752 | 0.16711 |
| pMON138793 | I-SETit.PIP1__1__2-1:1:1 | 249 | 0.11305 | 0.14472 |
| pMON33449 | No intron | | 0.10504 | 0.14472 |
| pMON140764 | I-SETit.Prx17-2-1:1:1 | 257 | 0.10398 | 0.16711 |
| pMON140771 | I-SETit.LSm8-3-1:1:1 | 245 | 0.09975 | 0.14472 |

TABLE 20-continued

Intron-mediated enhancement of GUS expression in corn protoplasts relative to I-Zm.DnaK-1:1:1 (SEQ ID NO: 1102) using 0.3 pmol of amplicon DNA.

| Construct | Intron Annotation | Intron SEQ ID NO: | Mean | Std Deviation |
|---|---|---|---|---|
| pMON138797 | I-SETit.PIP1-1__1-1:1:1 | 250 | 0.03152 | 0.14472 |
| pMON138799 | I-SETit.TubA2__1-1:1:1 | 262 | 0.01853 | 0.14472 |
| No DNA | | | 0.001 | 0.20467 |

Using 0.3 pmol of amplicon, most of the test intron elements, derived from *S. italica*, enhanced GUS expression relative to the no intron controls using a similar promoter (pMON8677 and pMON33449). Improved enhancement of GUS expression, relative to the intron element, I-Zm.DnaK-1:1:1 (SEQ ID NO: 1102) was observed for the intron elements, I-SETit.eIF5A1-1-1:1:1 (SEQ ID NO: 222), I-SETit.60S_L10A1-5-1:1:2 (SEQ ID NO: 215), I-SETit.GRP-1-1:1:1 (SEQ ID NO: 242), I-SETit.LSm8-1-1:1:2 (SEQ ID NO: 243), I-SETit.60S_L10A1-2-1:1:2 (SEQ ID NO: 212), I-SETit.TubA2_3-1:1:1 (SEQ ID NO: 264), I-SETit.14-3-3A-3-1:1:2 (SEQ ID NO: 180), I-SETit.eIF5A1-3-1:1:2 (SEQ ID NO: 224), I-SETit.14-3-3E-4-1:1:2 (SEQ ID NO: 199), I-SETit.PIP1-4_3-1:1:2 (SEQ ID NO: 252), I-SETit.PGK3_1-1:1:2 (SEQ ID NO: 247), I-SETit.40S-75-3_1-1:1:2 (SEQ ID NO: 208), I-SETit.PIP1-1_3-1:1:2 (SEQ ID NO: 251), I-SETit.LSm8-4-1:1:2 (SEQ ID NO: 246), I-SETit.eIF5A2-2-1:1:3 (SEQ ID NO: 228), I-SETit.14-3-3E-3-1:1:2 (SEQ ID NO: 198), I-SETit.LSm8-2-1:1:1 (SEQ ID NO: 244), I-SETit.14-3-3A-2-1:1:1 (SEQ ID NO: 179), I-SETit.eIF5A3-3-1:1:2 (SEQ ID NO: 234), I-SETit.14-3-3B-2-1:1:1 (SEQ ID NO: 183), I-SETit.14-3-3D-4-1:1:3 (SEQ ID NO: 195), I-SETit.14-3-3C-1-1:1:1 (SEQ ID NO: 187), I-SETit.14-3-3C-3-1:1:2 (SEQ ID NO: 189), I-SETit.DnaJ_1-1:1:2 (SEQ ID NO: 218), I-SETit.eIF5A3-2-1:1:2 (SEQ ID NO: 233), I-SETit.40S-75-1_2-1:1:2 (SEQ ID NO: 202), I-SETit.eIF5A3-4-1:1:2 (SEQ ID NO: 235) and I-SETit.ASA2-3-1:1:2 (SEQ ID NO: 216). Data shown in Table 21 below.

TABLE 21

Intron-mediated enhancement of GUS expression in corn protoplasts relative to I-Zm.DnaK-1:1:1 (SEQ ID NO: 1102) using 0.1 pmol amplicon DNA.

| Construct | Intron Annotation | Intron SEQ ID NO: | Mean | Std Deviation |
|---|---|---|---|---|
| pMON138842 | I-SETit.eIF5A1-1-1:1:1 | 222 | 3.19777 | 0.14472 |
| pMON140750 | I-SETit.60S_L10A1-5-1:1:2 | 215 | 2.73551 | 0.14472 |
| pMON138806 | I-SETit.GRP-1-1:1:1 | 242 | 2.24406 | 0.16711 |
| pMON140768 | I-SETit.LSm8-1-1:1:2 | 243 | 1.79949 | 0.14472 |
| pMON138847 | I-SETit.60S_L10A1-2-1:1:2 | 212 | 1.76055 | 0.14472 |
| pMON138805 | I-SETit.TubA2_3-1:1:1 | 264 | 1.6441 | 0.16711 |
| pMON138826 | I-SETit.14-3-3A-3-1:1:2 | 180 | 1.59333 | 0.14472 |
| pMON138844 | I-SETit.eIF5A1-3-1:1:2 | 224 | 1.51864 | 0.16711 |
| pMON138845 | I-SETit.14-3-3E-4-1:1:2 | 199 | 1.47841 | 0.14472 |
| pMON138785 | I-SETit.PIP1-4_3-1:1:2 | 252 | 1.45536 | 0.14472 |
| pMON138812 | I-SETit.PGK3_1-1:1:2 | 247 | 1.36129 | 0.14472 |
| pMON138809 | I-SETit.40S-7S-3_1-1:1:2 | 208 | 1.35665 | 0.14472 |
| pMON138796 | I-SETit.PIP1-1_3-1:1:2 | 251 | 1.30268 | 0.14472 |
| pMON140762 | I-SETit.LSm8-4-1:1:2 | 246 | 1.28583 | 0.14472 |
| pMON138839 | I-SETit.eIF5A2-2-1:1:3 | 228 | 1.26341 | 0.16711 |
| pMON138836 | I-SETit.14-3-3E-3-1:1:2 | 198 | 1.23008 | 0.14472 |
| pMON140767 | I-SETit.LSm8-2-1:1:1 | 244 | 1.22373 | 0.14472 |
| pMON138824 | I-SETit.14-3-3A-2-1:1:1 | 179 | 1.2226 | 0.16711 |
| pMON140754 | I-SETit.eIF5A3-3-1:1:2 | 234 | 1.22009 | 0.14472 |
| pMON138829 | I-SETit.14-3-3B-2-1:1:1 | 183 | 1.17955 | 0.14472 |
| pMON138827 | I-SETit.14-3-3D-4-1:1:3 | 195 | 1.15355 | 0.14472 |
| pMON138831 | I-SETit.14-3-3C-1-1:1:1 | 187 | 1.13972 | 0.20467 |
| pMON138817 | I-SETit.14-3-3C-3-1:1:2 | 189 | 1.09812 | 0.14472 |
| pMON138783 | I-SETit.DnaJ_1-1:1:2 | 218 | 1.08489 | 0.14472 |
| pMON140769 | I-SETit.eIF5A3-2-1:1:2 | 233 | 1.0434 | 0.14472 |
| pMON138792 | I-SETit.40S-7S-1_2-1:1:2 | 202 | 1.04308 | 0.16711 |
| pMON140760 | I-SETit.eIF5A3-4-1:1:2 | 235 | 1.04187 | 0.14472 |
| pMON140758 | I-SETit.ASA2-3-1:1:2 | 216 | 1.01034 | 0.14472 |
| pMON19469 | I-Zm.DnaK-1:1:1 | 1102 | 1 | 0.14472 |
| pMON140761 | I-SETit.SBD-2-1:1:1 | 260 | 0.99105 | 0.16711 |
| pMON138794 | I-SETit.40S-7S-1__1-1:1:2 | 201 | 0.98962 | 0.14472 |
| pMON138789 | I-SETit.PIP2-2_3-1:1:2 | 254 | 0.96195 | 0.14472 |
| pMON138791 | I-SETit.40S-7S-1__3-1:1:2 | 203 | 0.94544 | 0.14472 |
| pMON138830 | I-SETit.14-3-3B-3-1:1:2 | 184 | 0.92124 | 0.16711 |

TABLE 21-continued

Intron-mediated enhancement of GUS expression in corn protoplasts relative to I-Zm.DnaK-1:1:1 (SEQ ID NO: 1102) using 0.1 pmol amplicon DNA.

| Construct | Intron Annotation | Intron SEQ ID NO: | Mean | Std Deviation |
|---|---|---|---|---|
| pMON140766 | I-SETit.Prx3-1-1:1:2 | 258 | 0.88915 | 0.14472 |
| pMON138803 | I-SETit.TubA3__2-1:1:1 | 266 | 0.83768 | 0.16711 |
| pMON138832 | I-SETit.14-3-3C-4-1:1:2 | 190 | 0.80355 | 0.14472 |
| pMON138848 | I-SETit.DnaJ3-2-1:1:2 | 219 | 0.7898 | 0.16711 |
| pMON138835 | I-SETit.14-3-3E-2-1:1:1 | 197 | 0.78927 | 0.14472 |
| pMON138834 | I-SETit.eIF5A1-4-1:1:2 | 225 | 0.77272 | 0.14472 |
| pMON138821 | I-SETit.14-3-3B-5-1:1:2 | 186 | 0.671 | 0.14472 |
| pMON138849 | I-SETit.eIF5A2-4-1:1:2 | 230 | 0.67063 | 0.14472 |
| pMON138786 | I-SETit.eEF1g__1-1:1:2 | 220 | 0.6574 | 0.16711 |
| pMON140756 | I-SETit.eIF5A2-5-1:1:2 | 231 | 0.6269 | 0.16711 |
| pMON65328 | I-Os.Act1-1:1:19 | 1113 | 0.58395 | 0.14472 |
| pMON138840 | I-SETit.60S__L10A1-3-1:1:2 | 213 | 0.57366 | 0.14472 |
| pMON138822 | I-SETit.14-3-3C-5-1:1:2 | 191 | 0.55845 | 0.14472 |
| pMON140757 | I-SETit.ClpD-1-1:1:1 | 217 | 0.53607 | 0.14472 |
| pMON140753 | I-SETit.eIF5A3-1-1:1:1 | 232 | 0.52545 | 0.14472 |
| pMON138820 | I-SETit.14-3-3B-4-1:1:2 | 185 | 0.52034 | 0.16711 |
| pMON138800 | I-SETit.40S-7S-3__3-1:1:2 | 210 | 0.51862 | 0.16711 |
| pMON138828 | I-SETit.14-3-3D-2-1:1:1 | 193 | 0.51592 | 0.14472 |
| pMON138813 | I-SETit.14-3-3A-5-1:1:2 | 182 | 0.51379 | 0.14472 |
| pMON138843 | I-SETit.14-3-3D-5-1:1:2 | 196 | 0.50543 | 0.14472 |
| pMON138825 | I-SETit.14-3-3D-1-1:1:2 | 192 | 0.48895 | 0.14472 |
| pMON138814 | I-SETit.14-3-3D-3-1:1:2 | 194 | 0.48519 | 0.14472 |
| pMON138818 | I-SETit.GAD__4-1:1:2 | 240 | 0.47986 | 0.14472 |
| pMON138811 | I-SETit.TubA3__1-1:1:1 | 265 | 0.47762 | 0.16711 |
| pMON138823 | I-SETit.14-3-3C-2-1:1:1 | 188 | 0.41543 | 0.14472 |
| pMON138837 | I-SETit.60S__L10A1-1-1:1:2 | 211 | 0.40991 | 0.14472 |
| pMON138846 | I-SETit.eIF5A2-3-1:1:2 | 229 | 0.40485 | 0.14472 |
| pMON140763 | I-SETit.eIF5A3-5-1:1:2 | 236 | 0.40131 | 0.14472 |
| pMON138838 | I-SETit.eIF5A2-1-1:1:2 | 227 | 0.37694 | 0.14472 |
| pMON138801 | I-SETit.TubA2__2-1:1:1 | 263 | 0.35386 | 0.14472 |
| pMON138804 | I-SETit.PGK3__2-1:1:1 | 248 | 0.35284 | 0.16711 |
| pMON140765 | I-SETit.Grf1-3-1:1:1 | 241 | 0.32325 | 0.16711 |
| pMON140755 | I-SETit.Wx1-1-1:1:2 | 267 | 0.31895 | 0.16711 |
| pMON138790 | I-SETit.PIP2-5__2-1:1:2 | 255 | 0.2957 | 0.16711 |
| pMON140770 | I-SETit.SBD-1-1:1:2 | 259 | 0.29309 | 0.14472 |
| pMON138784 | I-SETit.PIP2-2__2-1:1:2 | 253 | 0.29174 | 0.14472 |
| pMON138808 | I-SETit.GAD__1-1:1:2 | 237 | 0.2874 | 0.14472 |
| pMON138807 | I-SETit.40S-7S-2__4-1:1:1 | 207 | 0.27522 | 0.16711 |
| pMON138819 | I-SETit.GAD__2-1:1:2 | 238 | 0.27038 | 0.14472 |
| pMON138833 | I-SETit.eIF5A1-2-1:1:2 | 223 | 0.25147 | 0.14472 |
| pMON138795 | I-SETit.PIP2-5__3-1:1:2 | 256 | 0.24221 | 0.14472 |
| pMON138802 | I-SETit.40S-7S-2__3-1:1:1 | 206 | 0.23983 | 0.16711 |
| pMON25455 EXP-Os.Act1 (SEQ ID NO: 1098) | EXP-Os.Act1 | | 0.21736 | 0.16711 |
| pMON140759 | I-SETit.SBD-3-1:1:2 | 261 | 0.2172 | 0.16711 |
| pMON138787 | I-SETit.eEF1g__4-1:1:3 | 221 | 0.17568 | 0.14472 |
| pMON138810 | I-SETit.40S-7S-3__2-1:1:2 | 209 | 0.16997 | 0.14472 |
| pMON138816 | I-SETit.14-3-3A-4-1:1:2 | 181 | 0.16765 | 0.14472 |
| pMON138815 | I-SETit.GAD__3-1:1:2 | 239 | 0.16017 | 0.20467 |
| pMON138788 | I-SETit.40S-7S-1__4-1:1:2 | 204 | 0.15842 | 0.16711 |
| pMON140752 | I-SETit.60S__L10A1-4-1:1:1 | 214 | 0.15302 | 0.14472 |
| pMON140751 | I-SETit.eIF5A1-5-1:1:2 | 226 | 0.14712 | 0.14472 |
| pMON138841 | I-SETit.14-3-3E-5-1:1:2 | 200 | 0.14157 | 0.14472 |
| pMON8677 | No intron | | 0.14109 | 0.14472 |
| pMON138798 | I-SETit.40S-7S-2__2-1:1:1 | 205 | 0.11752 | 0.16711 |
| pMON138793 | I-SETit.PIP1__1__2-1:1:1 | 249 | 0.11305 | 0.14472 |
| pMON33449 | No intron | | 0.10504 | 0.14472 |
| pMON140764 | I-SETit.Prx17-2-1:1:1 | 257 | 0.10398 | 0.16711 |
| pMON140771 | I-SETit.LSm8-3-1:1:1 | 245 | 0.09975 | 0.14472 |
| pMON138797 | I-SETit.PIP1-1__1-1:1:1 | 250 | 0.03152 | 0.14472 |
| pMON138799 | I-SETit.TubA2__1-1:1:1 | 262 | 0.01853 | 0.14472 |
| No DNA | | | 0.001 | 0.20467 |

The basic trend in enhancement was similar using 0.1 pmol of amplicon. Most of the test intron elements, derived from S. italica, enhanced GUS expression relative to the no intron controls using a similar promoter (pMON8677 and pMON33449). Improved enhancement of GUS expression, relative to the intron element, I-Zm.DnaK-1:1:1 (SEQ ID NO: 1102) was observed using the intron elements, I-SETit.LSm8-1-1:1:2 (SEQ ID NO: 243), I-SETit.60S_L10A1-5-1:1:2 (SEQ ID NO: 215), I-SETit.eIF5A1-3-1:1:2 (SEQ ID NO: 224), I-SETit.GRP-1-1:1:1 (SEQ ID NO: 242), I-SETit.14-3-3D-2-1:1:1 (SEQ ID NO: 193), I-SETit.14-3-3D-3-1:1:2 (SEQ ID NO: 194), I-SETit.eIF5A3-3-1:1:2 (SEQ ID NO: 234), I-SETit.LSm8-4-1:1:2 (SEQ ID NO: 246), I-SETit.LSm8-2-1:1:1 (SEQ ID NO: 244), I-SETit.eIF5A3-2-1:1:2 (SEQ ID NO: 233), I-SETit.eIF5A1-4-1:1:2 (SEQ ID NO: 225), I-SETit.ASA2-3-1:1:2 (SEQ ID NO: 216), I-SETit.60S_L10A1-2-1:1:2 (SEQ ID NO: 212), I-SETit.eIF5A2-5-1:1:2 (SEQ ID NO: 231), I-SETit.14-3-3B-3-1:1:2 (SEQ ID NO: 184), I-SETit.14-3-3B-2-1:1:1 (SEQ ID NO: 183), I-SETit.DnaJ3-2-1:1:2 (SEQ ID NO: 219), I-SETit.14-3-3A-3-1:1:2 (SEQ ID NO: 180), I-SETit.eIF5A3-4-1:1:2 (SEQ ID NO: 235), I-SETit.14-3-3C-5-1:1:2 (SEQ ID NO: 191), I-SETit.TubA3_2-1:1:1 (SEQ ID NO: 266), I-SETit.40S-75-1_3-1:1:2 (SEQ ID NO: 203), I-SETit.TubA2_3-1:1:1 (SEQ ID NO: 264), I-SETit.14-3-3C-3-1:1:2 (SEQ ID NO: 189), I-SETit.Prx3-1-1:1:2 (SEQ ID NO: 258) and I-SETit.DnaJ_1-1:1:2 (SEQ ID NO: 218).

Example 14

Analysis of Intron-Mediated Enhancement of GUS Activity Using Wheat Protoplasts

Protoplast cells, derived from wheat leaf tissue, are transformed with transgene cassettes in the form of PCR amplicons to determine the effect of each intron on the expression of the transgene, GUS, driven by a constitutive promoter and compared to introns known to have an enhancement effect on transgene expression.

The constructs described in example 12 above and presented in Table 19 of example 12 were used as template to generate PCR amplicons using methods known in the art comprising a constitutive promoter, P-CaMV.35S-enh-1:1:13 (SEQ ID NO: 1112), operably linked 5' to a leader element, L-CaMV.35S-1:1:15 (SEQ ID NO: 1111), operably linked to a test intron element (SEQ ID NOS: 179 through 267), operably linked 5' to a GUS coding sequence, (GUS-1, SEQ ID NO: 1090), operably linked 5' to the Nopaline synthase 3' termination region from A. tumefaciens (T-AGR-tu.nos-1:1:13, SEQ ID NO: 1088). In addition, amplicons, derived from control plasmids were also generated using the same amplification methods from the control plasmid constructs, pMON19469, pMON65328, pMON25455, pMON8677 and pMON33449. The transgene cassette of pMON19469 is comprised of the transcriptional regulatory element group, EXP-CaMV.35S-enh/1-Zm.DnaK-1:1:1 (SEQ ID NO: 1104) and provides a comparison of the constitutive promoter enhanced using the intron I-Zm.DnaK-1:1:1. The transgene cassette of pMON65328 is comprised of the transcriptional regulatory element group, EXP-CaMV.35S-enh-Lhcb1/I-Os.Act1-1:1:9 (SEQ ID NO: 1105) and provides a comparison of enhancement of the constitutive promoter using the intron, I-Os.Act1-1:1:9. The transgene cassette of pMON25455 is comprised of the transcriptional regulatory element group, EXP-Os.Act1:1:1 (SEQ ID NO: 1098) and provides a comparison of expression using the native promoter, leader and intron of the rice actin 1 gene. The transgene cassette of pMON8677 is comprised of the promoter, P-CaMV.35S-enh-1:1:9 (SEQ ID NO: 1096) operably linked to the GUS coding sequence and provides a comparison of expression with a constitutive promoter without an intron for enhancement. The transgene cassette of pMON33449 is comprised of a variant of the CaMV 35S promoter (P-E35S:1:52, SEQ ID NO: 1117) and provides an additional comparator lacking an intron.

Protoplast cells, derived from wheat leaf tissue are transformed using PEG-based transformation methods known in the art. Briefly, each test and control construct is used to provide template for amplification of the transgene cassette comprising each construct. The resulting amplicon is size fractionated on an agarose gel and the amplicon DNA is excised from the gel. The amplicon DNA is extracted from the gel fragment using methods known in the art and quantified by spectrophotometry. Protoplast cells are transformed using PEG methods known in the art and using 0.1 pico-moles of PCR amplicon DNA. Two to four replicates are performed for each transformation and the average expression imparted by each construct determined. The mean GUS expression observed for each construct derived amplicon is normalized with respect to expression observed for the amplicon derived from pMON19469 comprised of the intron element, I-Zm.DnaK-1:1:1 (SEQ ID NO: 1102). Tables 22 below show the normalized average GUS expression imparted amplicons derived from the constructs presented in Table 19 of Example 12 relative to the average GUS expression imparted to amplicons derived from the control plasmids described above using 0.1 pmol of amplicon.

TABLE 22

Intron-mediated enhancement of GUS expression in wheat protoplasts relative to I-Zm.DnaK-1:1:1 (SEQ ID NO: 1102).

| Construct | Intron Annotation | Intron SEQ ID NO: | Mean | Std Deviation |
|---|---|---|---|---|
| pMON140768 | I-SETit.LSm8-1-1:1:2 | 243 | 2.26 | 0.51 |
| pMON140750 | I-SETit.60S_L10A1-5-1:1:2 | 215 | 2.14 | 0.62 |
| pMON65328 | I-Os.Act1-1:1:19 | 1113 | 2.06 | 0.96 |
| pMON138844 | I-SETit.eIF5A1-3-1:1:2 | 224 | 1.92 | 0.29 |
| pMON138806 | I-SETit.GRP-1-1:1:1 | 242 | 1.81 | 0.64 |
| pMON138828 | I-SETit.14-3-3D-2-1:1:1 | 193 | 1.75 | 0.71 |
| pMON138814 | I-SETit.14-3-3D-3-1:1:2 | 194 | 1.71 | 0.26 |
| pMON140754 | I-SETit.eIF5A3-3-1:1:2 | 234 | 1.66 | 0.61 |
| pMON140762 | I-SETit.LSm8-4-1:1:2 | 246 | 1.6 | 0.52 |
| pMON140767 | I-SETit.LSm8-2-1:1:1 | 244 | 1.55 | 0.26 |
| pMON140769 | I-SETit.eIF5A3-2-1:1:2 | 233 | 1.53 | 0.52 |
| pMON138834 | I-SETit.eIF5A1-4-1:1:2 | 225 | 1.44 | 0.67 |
| pMON140758 | I-SETit.ASA2-3-1:1:2 | 216 | 1.37 | 0.25 |
| pMON138847 | I-SETit.60S_L10A1-2-1:1:2 | 212 | 1.34 | 1.03 |
| pMON140756 | I-SETit.eIF5A2-5-1:1:2 | 231 | 1.33 | 0.53 |
| pMON138830 | I-SETit.14-3-3B-3-1:1:2 | 184 | 1.2 | 0.23 |
| pMON138829 | I-SETit.14-3-3B-2-1:1:1 | 183 | 1.18 | 0.41 |
| pMON138848 | I-SETit.DnaJ3-2-1:1:2 | 219 | 1.17 | 0.1 |
| pMON138826 | I-SETit.14-3-3A-3-1:1:2 | 180 | 1.12 | 0.23 |
| pMON140760 | I-SETit.eIF5A3-4-1:1:2 | 235 | 1.12 | 0.49 |
| pMON138822 | I-SETit.14-3-3C-5-1:1:2 | 191 | 1.1 | 0.33 |
| pMON138803 | I-SETit.TubA3_2-1:1:1 | 266 | 1.08 | 0.19 |
| pMON138791 | I-SETit.40S-7S-1_3-1:1:2 | 203 | 1.06 | 0.13 |
| pMON138805 | I-SETit.TubA2_3-1:1:1 | 264 | 1.03 | 0.34 |
| pMON138817 | I-SETit.14-3-3C-3-1:1:2 | 189 | 1.03 | 0.16 |
| pMON140766 | I-SETit.Prx3-1-1:1:2 | 258 | 1.03 | 0.45 |
| pMON138783 | I-SETit.DnaJ_1-1:1:2 | 218 | 1.02 | 0.43 |
| pMON19469 | I-Zm.DnaK-1:1:1 | 1102 | 1 | 0.96 |
| pMON138846 | I-SETit.eIF5A2-3-1:1:2 | 229 | 0.99 | 0.62 |
| pMON138819 | I-SETit.GAD_2-1:1:2 | 238 | 0.98 | 0.4 |
| pMON140753 | I-SETit.eIF5A3-1-1:1:1 | 232 | 0.98 | 0.16 |
| pMON138835 | I-SETit.14-3-3E-2-1:1:1 | 197 | 0.97 | 0.17 |
| pMON138836 | I-SETit.14-3-3E-3-1:1:2 | 198 | 0.95 | 0.36 |
| pMON138837 | I-SETit.60S_L10A1-1-1:1:2 | 211 | 0.93 | 0.57 |
| pMON138813 | I-SETit.14-3-3A-5-1:1:2 | 182 | 0.92 | 0.32 |

TABLE 22-continued

Intron-mediated enhancement of GUS expression in wheat protoplasts relative to I-Zm.DnaK-1:1:1 (SEQ ID NO: 1102).

| Construct | Intron Annotation | Intron SEQ ID NO: | Mean | Std Deviation |
|---|---|---|---|---|
| pMON138849 | I-SETit.eIF5A2-4-1:1:2 | 230 | 0.9 | 0.3 |
| pMON138809 | I-SETit.40S-7S-3_1-1:1:2 | 208 | 0.88 | 0.41 |
| pMON140770 | I-SETit.SBD-1-1:1:2 | 259 | 0.84 | 0.5 |
| pMON138811 | I-SETit.TubA3_1-1:1:1 | 265 | 0.83 | 0.12 |
| pMON138833 | I-SETit.eIF5A1-2-1:1:2 | 223 | 0.83 | 0.56 |
| pMON140761 | I-SETit.SBD-2-1:1:1 | 260 | 0.82 | 0.18 |
| pMON138832 | I-SETit.14-3-3C-4-1:1:2 | 190 | 0.77 | 0.44 |
| pMON140757 | I-SETit.ClpD-1-1:1:1 | 217 | 0.77 | 0.52 |
| pMON140759 | I-SETit.SBD-3-1:1:2 | 261 | 0.76 | 0.36 |
| pMON138812 | I-SETit.PGK3_1-1:1:2 | 247 | 0.75 | 0.45 |
| pMON140763 | I-SETit.eIF5A3-5-1:1:2 | 236 | 0.75 | 0.22 |
| pMON138824 | I-SETit.14-3-3A-2-1:1:1 | 179 | 0.74 | 0.39 |
| pMON138839 | I-SETit.eIF5A2-2-1:1:3 | 228 | 0.73 | 0.12 |
| pMON33449 | No intron | | 0.68 | 0.47 |
| pMON138841 | I-SETit.14-3-3E-5-1:1:2 | 200 | 0.67 | 0.35 |
| pMON138827 | I-SETit.14-3-3D-4-1:1:3 | 195 | 0.63 | 0.45 |
| pMON138815 | I-SETit.GAD_3-1:1:2 | 239 | 0.6 | 0.15 |
| pMON25455 EXP-Os.Act1 (SEQ ID NO: 1098) | EXP-Os.Act1 | | 0.57 | 0.49 |
| pMON138804 | I-SETit.PGK3_2-1:1:1 | 248 | 0.56 | 0.42 |
| pMON138823 | I-SETit.14-3-3C-2-1:1:1 | 188 | 0.54 | 0.21 |
| pMON140752 | I-SETit.60S_L10A1-4-1:1:1 | 214 | 0.52 | 0.46 |
| pMON140755 | I-SETit.Wx1-1-1:1:2 | 267 | 0.52 | 0.41 |
| pMON138816 | I-SETit.14-3-3A-4-1:1:2 | 181 | 0.51 | 0.2 |
| pMON138808 | I-SETit.GAD_1-1:1:2 | 237 | 0.5 | 0.42 |
| pMON138820 | I-SETit.14-3-3B-4-1:1:2 | 185 | 0.5 | 0.35 |
| pMON138831 | I-SETit.14-3-3C-1-1:1:1 | 187 | 0.49 | 0.42 |
| pMON138838 | I-SETit.eIF5A2-1-1:1:2 | 227 | 0.49 | 0.39 |
| pMON138792 | I-SETit.40S-7S-1_2-1:1:2 | 202 | 0.47 | 0.49 |
| pMON138799 | I-SETit.TubA2_1-1:1:1 | 262 | 0.47 | 0.15 |
| pMON140765 | I-SETit.Grf1-3-1:1:1 | 241 | 0.47 | 0.38 |
| pMON138843 | I-SETit.14-3-3D-5-1:1:2 | 196 | 0.46 | 0.49 |
| pMON140771 | I-SETit.LSm8-3-1:1:1 | 245 | 0.43 | 0.25 |
| pMON138789 | I-SETit.PIP2-2_3-1:1:2 | 254 | 0.42 | 0.26 |
| pMON138794 | I-SETit.40S-7S-1_1-1:1:2 | 201 | 0.4 | 0.28 |
| pMON138788 | I-SETit.40S-7S-1_4-1:1:2 | 204 | 0.39 | 0.32 |
| pMON138840 | I-SETit.60S_L10A1-3-1:1:2 | 213 | 0.39 | 0.35 |
| pMON140751 | I-SETit.eIF5A1-5-1:1:2 | 226 | 0.39 | 0.48 |
| pMON138785 | I-SETit.PIP1-4_3-1:1:2 | 252 | 0.38 | 0.33 |
| pMON8677 | No intron | | 0.38 | 0.36 |
| pMON138821 | I-SETit.14-3-3B-5-1:1:2 | 186 | 0.37 | 0.23 |
| pMON138825 | I-SETit.14-3-3D-1-1:1:2 | 192 | 0.37 | 0.31 |
| pMON138797 | I-SETit.PIP1-1_1-1:1:1 | 250 | 0.33 | 0.39 |
| pMON140764 | I-SETit.Prx17-2-1:1:1 | 257 | 0.33 | 0.41 |
| pMON138786 | I-SETit.eEF1g_1-1:1:2 | 220 | 0.32 | 0.29 |
| pMON138818 | I-SETit.GAD_4-1:1:2 | 240 | 0.32 | 0.09 |
| pMON138802 | I-SETit.40S-7S-2_3-1:1:1 | 206 | 0.3 | 0.22 |
| pMON138801 | I-SETit.TubA2_2-1:1:1 | 263 | 0.29 | 0.2 |
| pMON138793 | I-SETit.PIP1_1_2-1:1:1 | 249 | 0.24 | 0.33 |
| pMON138807 | I-SETit.40S-7S-2_4-1:1:1 | 207 | 0.24 | 0.3 |
| pMON138800 | I-SETit.40S-7S-3_3-1:1:2 | 210 | 0.22 | 0.11 |
| pMON138795 | I-SETit.PIP2-5_3-1:1:2 | 256 | 0.21 | 0.19 |
| pMON138790 | I-SETit.PIP2-5_2-1:1:2 | 255 | 0.19 | 0.18 |
| pMON138796 | I-SETit.PIP1-1_3-1:1:2 | 251 | 0.18 | 0.19 |
| pMON138810 | I-SETit.40S-7S-3_2-1:1:2 | 209 | 0.17 | 0.16 |
| pMON138787 | I-SETit.eEF1g_4-1:1:3 | 221 | 0.13 | 0.17 |
| pMON138784 | I-SETit.PIP2-2_2-1:1:2 | 253 | 0.1 | 0.15 |
| pMON138798 | I-SETit.40S-7S-2_2-1:1:1 | 205 | 0.09 | 0.09 |
| No DNA | | | 0 | 0 |
| pMON138842 | I-SETit.eIF5A1-1-1:1:1 | 222 | | |
| pMON138845 | I-SETit.14-3-3E-4-1:1:2 | 199 | | |

As was observed in corn protoplast cells, many of the test intron elements provided enhancement of transgene expression relative to the intronless controls. Improved enhancement of GUS expression, relative to the intron element, I-Zm.DnaK-1:1:1 (SEQ ID NO: 1102) was observed using the intron elements, I-SETit.LSm8-1-1:1:2 (SEQ ID NO: 243), I-SETit.60S_L10A1-5-1:1:2 (SEQ ID NO: 215), I-SETit.eIF5A1-3-1:1:2 (SEQ ID NO: 224), I-SETit.GRP-1-1:1:1 (SEQ ID NO: 242), I-SETit.14-3-3D-2-1:1:1 (SEQ ID NO: 193), I-SETit.14-3-3D-3-1:1:2 (SEQ ID NO: 194), I-SETit.eIF5A3-3-1:1:2 (SEQ ID NO: 234), I-SETit.LSm8-4-1:1:2 (SEQ ID NO: 246), I-SETit.LSm8-2-1:1:1 (SEQ ID NO: 244), I-SETit.eIF5A3-2-1:1:2 (SEQ ID NO: 233), I-SETit.eIF5A1-4-1:1:2 (SEQ ID NO: 225), I-SETit.ASA2-3-1:1:2 (SEQ ID NO: 216), I-SETit.60S_L10A1-2-1:1:2 (SEQ ID NO: 212), I-SETit.eIF5A2-5-1:1:2 (SEQ ID NO: 231), I-SETit.14-3-3B-3-1:1:2 (SEQ ID NO: 184), I-SETit.14-3-3B-2-1:1:1 (SEQ ID NO: 183), I-SETit.DnaJ3-2-1:1:2 (SEQ ID NO: 219), I-SETit.14-3-3A-3-1:1:2 (SEQ ID NO: 180), I-SETit.eIF5A3-4-1:1:2 (SEQ ID NO: 235), I-SETit.14-3-3C-5-1:1:2 (SEQ ID NO: 191), I-SETit.TubA3_2-1:1:1 (SEQ ID NO: 266), I-SETit.40S-75-1_3-1:1:2 (SEQ ID NO: 203), I-SETit.TubA2_3-1:1:1 (SEQ ID NO: 264), I-SETit.14-3-3C-3-1:1:2 (SEQ ID NO: 189), I-SETit.Prx3-1-1:1:2 (SEQ ID NO: 258) and I-SETit.DnaJ_1-1:1:2 (SEQ ID NO: 218).

Example 15

Assay of 3' Transcription Termination Molecule or 3' UTRs in Protoplasts

3' transcription termination molecules or 3' UTRs are isolated from Foxtail millet (Setaria italica (L.) Beauv) and cloned into plant base vectors using methods known in the art to test the effectiveness of the 3' UTR in terminating transcription as well as enhancing expression of a transgene.

3' UTRs useful in providing expression of a transgene in plants are identified based upon the expression of expressed sequence tags (ESTs) in cDNA libraries made from messenger RNA isolated from seed, flower and other tissues derived from Foxtail millet (Setaria italica (L.) Beauv). Libraries of cDNA are made from tissues isolated from S. italica using methods known to those skilled in the art from flower tissue, seed, leaf and root. The resulting cDNAs are sequenced using various sequencing methods known in the art. The resulting ESTs are assembled into clusters using bioinformatics software such as clc_ref_assemble_complete version 2.01.37139 (CLC bio USA, Cambridge, Mass. 02142). Transcript abundance of each cluster is determined by counting the number of cDNA reads for each cluster.

The identified 3' UTRs may be comprised of sequence derived from cDNA sequence as well as sequence derived from genomic DNA. The cDNA sequence is used to design primers, which are then used with GenomeWalker™ (Clontech Laboratories, Inc, Mountain View, Calif.) libraries constructed following the manufacturer's protocol to clone the 3' region of the corresponding genomic DNA sequence to provide a longer termination sequence. Analysis of relative transcript abundance either by direct counts or normalized counts of observed sequence reads for each tissue library can be used to infer properties about patters of expression. For example, some 3' UTRs may be found in transcripts seen in higher abundance in root tissue as opposed to leaf. This is suggestive that the transcript is highly expressed in root and that the properties of root expression may be attributable to the transcriptional regulation of the promoter, the lead, the introns or the 3' UTR. Empirical testing of 3' UTRs identified by the properties of expression within specific organs, tissues or cell types can result in the identification of 3' UTRs that enhance expression in those specific organs, tissues or cell types.

3' UTR sequences isolated from S. italica are presented as SEQ ID NOS: 268 through 276 and SEQ ID NOS: 779 through 924. Table 23 below presents 3' UTRs identified as being useful for control of expression and enhancement of root expression or constitutive expression.

TABLE 23

Transcription termination or 3' UTR elements derived from *S. italica*.

| Annotation | SEQ ID NO: | Description |
|---|---|---|
| T-SETit.Act1-1:1:1 | 268 | Actin 1 |
| T-SETit.Act8-1:1:1 | 269 | Actin 8 |
| T-SETit.Ams1-1:1:1 | 270 | S-adenosylmethionine synthetase 1 |
| T-SETit.Ctpt-1:1:2 | 271 | Triose phosphate/phosphate translocator, chloroplast precursor |
| T-SETit.Fba-1:1:1 | 272 | Fructose-bisphosphate aldolase |
| T-SETit.Fnr-1:1:1 | 273 | Ferredoxin-NADP+ reductase |
| T-SETit.Mes2-1:1:1 | 274 | Methionine synthase 2 |
| T-SETit.Ntr-1:1:1 | 275 | Nitrite transporter |
| T-SETit.Sus2-1:1:1 | 276 | Sucrose synthase 2 |
| T-SETit.36384-1:1:1 | 779 | Cluster 36384 |
| T-SETit.37025-1:1:1 | 780 | Cluster 37025 |
| T-SETit.37470-1:1:1 | 781 | Cluster 37470 |
| T-SETit.Ams2-1:1:1 | 782 | S-adenosylmethionine synthetase 2 |
| T-SETit.Atps-1:1:1 | 783 | ATP synthase subunit gamma |
| T-SETit.Cab-1:1:1 | 784 | Chlorophyll a/b binding protein |
| T-SETit.Cab1-1:1:1 | 785 | Chlorophyll a/b binding protein |
| T-SETit.Ctpt-1:1:1 | 786 | Triose phosphate/phosphate translocator, chloroplast precursor |
| T-SETit.DnaK-1:1:1 | 787 | Heat shock protein |
| T-SETit.Fba-1:1:2 | 788 | Fructose-bisphosphate aldolase |
| T-SETit.Fba-1:1:3 | 789 | Fructose-bisphosphate aldolase |
| T-SETit.Fba-1:1:4 | 790 | Fructose-bisphosphate aldolase |
| T-SETit.Gapdh-1:1:1 | 791 | Glyceraldehyde-3-phosphate dehydrogenase |
| T-SETit.MES2__nno-1:1:1 | 792 | Methionine synthase 2 |
| T-SETit.Oep-1:1:1 | 793 | 33 kDa oxygen evolving protein |
| T-SETit.Pea-1:1:1 | 794 | Proton-exporting ATPase |
| T-SETit.Pod-1:1:1 | 795 | pyruvate orthophosphate dikinase |
| T-SETit.Ppc-1:1:1 | 796 | Phosphoenolpyruvate carboxylase |
| T-SETit.Psi-K-1:1:1 | 797 | Photosystem I reaction center subunit |
| T-SETit.Psi-L-1:1:1 | 798 | Photosystem I reaction center subunit |
| T-SETit.Rfe-s-1:1:1 | 799 | Rieske Fe—S |
| T-SETit.TubA-1:1:1 | 800 | Tubulin A |
| T-contig00388 | 801 | Root 3' UTR |
| T-contig05482 | 802 | Root 3' UTR |
| T-contig08555 | 803 | Root 3' UTR |
| T-contig08556 | 804 | Root 3' UTR |
| T-contig09485 | 805 | Root 3' UTR |
| T-contig13749 | 806 | Root 3' UTR |
| T-contig16157 | 807 | Root 3' UTR |
| T-contig18936 | 808 | Root 3' UTR |
| T-contig18994 | 809 | Root 3' UTR |
| T-contig21387 | 810 | Root 3' UTR |
| T-contig23385 | 811 | Root 3' UTR |
| T-contig24188 | 812 | Root 3' UTR |
| T-contig24188 | 813 | Root 3' UTR |
| T-contig24832 | 814 | Root 3' UTR |
| T-contig24890 | 815 | Root 3' UTR |
| T-contig24916 | 816 | Root 3' UTR |
| T-contig25097 | 817 | Root 3' UTR |
| T-contig25509 | 818 | Root 3' UTR |
| T-contig25584 | 819 | Root 3' UTR |
| T-contig26532 | 820 | Root 3' UTR |
| T-contig28013 | 821 | Root 3' UTR |
| T-contig29922 | 822 | Root 3' UTR |
| T-contig34261 | 823 | Root 3' UTR |
| T-contig34311 | 824 | Root 3' UTR |
| T-contig34749 | 825 | Root 3' UTR |
| T-contig35408 | 826 | Root 3' UTR |
| T-contig35550 | 827 | Root 3' UTR |
| T-contig35785 | 828 | Root 3' UTR |
| T-contig35943 | 829 | Root 3' UTR |
| T-contig36050 | 830 | Root 3' UTR |
| T-contig36266 | 831 | Root 3' UTR |
| T-contig36378 | 832 | Root 3' UTR |
| T-contig36502 | 833 | Root 3' UTR |
| T-contig36728 | 834 | Root 3' UTR |
| T-contig36811 | 835 | Root 3' UTR |
| T-contig36883 | 836 | Root 3' UTR |
| T-contig37316 | 837 | Root 3' UTR |
| T-contig37476 | 838 | Root 3' UTR |
| T-contig37510 | 839 | Root 3' UTR |
| T-contig37704 | 840 | Root 3' UTR |

TABLE 23-continued

Transcription termination or 3' UTR elements derived from *S. italica*.

| Annotation | SEQ ID NO: | Description |
|---|---|---|
| T-contig37883 | 841 | Root 3' UTR |
| T-contig37920 | 842 | Root 3' UTR |
| T-contig37959 | 843 | Root 3' UTR |
| T-contig37976 | 844 | Root 3' UTR |
| T-contig38003 | 845 | Root 3' UTR |
| T-SETIT-28JUL09-CLUS3016__12 | 846 | Root 3' UTR |
| T-10SETIT-28JUL09-CLUS1332__4 | 847 | Constitutive 3' UTR |
| T-17SETIT-28JUL09-CLUS1910__15 | 848 | Constitutive 3' UTR |
| T-7SETIT-28JUL09-CLUS2844__11 | 849 | Constitutive 3' UTR |
| T-contig00006 | 850 | Constitutive 3' UTR |
| T-contig00142 | 851 | Constitutive 3' UTR |
| T-contig00191 | 852 | Constitutive 3' UTR |
| T-contig00205 | 853 | Constitutive 3' UTR |
| T-contig00242 | 854 | Constitutive 3' UTR |
| T-contig00263 | 855 | Constitutive 3' UTR |
| T-contig01883 | 856 | Constitutive 3' UTR |
| T-contig02157 | 857 | Constitutive 3' UTR |
| T-contig02856 | 858 | Constitutive 3' UTR |
| T-contig02883 | 859 | Constitutive 3' UTR |
| T-contig04253 | 860 | Constitutive 3' UTR |
| T-contig05397 | 861 | Constitutive 3' UTR |
| T-contig05720 | 862 | Constitutive 3' UTR |
| T-contig10626 | 863 | Constitutive 3' UTR |
| T-contig10874 | 864 | Constitutive 3' UTR |
| T-contig11193 | 865 | Constitutive 3' UTR |
| T-contig14970 | 866 | Constitutive 3' UTR |
| T-contig26892 | 867 | Constitutive 3' UTR |
| T-contig32186 | 868 | Constitutive 3' UTR |
| T-contig32187 | 869 | Constitutive 3' UTR |
| T-contig33439 | 870 | Constitutive 3' UTR |
| T-contig33682 | 871 | Constitutive 3' UTR |
| T-contig34270 | 872 | Constitutive 3' UTR |
| T-contig34378 | 873 | Constitutive 3' UTR |
| T-contig35132 | 874 | Constitutive 3' UTR |
| T-contig35270 | 875 | Constitutive 3' UTR |
| T-contig35388 | 876 | Constitutive 3' UTR |
| T-contig35412 | 877 | Constitutive 3' UTR |
| T-contig35488 | 878 | Constitutive 3' UTR |
| T-contig35982 | 879 | Constitutive 3' UTR |
| T-contig36384 | 880 | Constitutive 3' UTR |
| T-contig36588 | 881 | Constitutive 3' UTR |
| T-contig36702 | 882 | Constitutive 3' UTR |
| T-contig36980 | 883 | Constitutive 3' UTR |
| T-contig36992 | 884 | Constitutive 3' UTR |
| T-contig36993 | 885 | Constitutive 3' UTR |
| T-contig37025 | 886 | Constitutive 3' UTR |
| T-contig37162 | 887 | Constitutive 3' UTR |
| T-contig37351 | 888 | Constitutive 3' UTR |
| T-contig37386 | 889 | Constitutive 3' UTR |
| T-contig37448 | 890 | Constitutive 3' UTR |
| T-contig37456 | 891 | Constitutive 3' UTR |
| T-contig37638 | 892 | Constitutive 3' UTR |
| T-contig37732 | 893 | Constitutive 3' UTR |
| T-contig37897 | 894 | Constitutive 3' UTR |
| T-contig37927 | 895 | Constitutive 3' UTR |
| T-contig37962 | 896 | Constitutive 3' UTR |
| T-contig37980 | 897 | Constitutive 3' UTR |
| T-SETIT-28JUL09-CLUS11107__1 | 898 | Constitutive 3' UTR |
| T-SETIT-28JUL09-CLUS11705__1 | 899 | Constitutive 3' UTR |
| T-SETIT-28JUL09-CLUS11899__1 | 900 | Constitutive 3' UTR |
| T-SETIT-28JUL09-CLUS12698__2 | 901 | Constitutive 3' UTR |
| T-SETIT-28JUL09-CLUS13580__1 | 902 | Constitutive 3' UTR |
| T-SETIT-28JUL09-CLUS1404__1 | 903 | Constitutive 3' UTR |
| T-SETIT-28JUL09-CLUS14743__1 | 904 | Constitutive 3' UTR |
| T-SETIT-28JUL09-CLUS181186__1 | 905 | Constitutive 3' UTR |
| T-SETIT-28JUL09-CLUS19095__1 | 906 | Constitutive 3' UTR |
| T-SETIT-28JUL09-CLUS1910__13 | 907 | Constitutive 3' UTR |
| T-SETIT-28JUL09-CLUS1910__14 | 908 | Constitutive 3' UTR |
| T-SETIT28JUL09CLUS1910__16 | 909 | Constitutive 3' UTR |
| T-SETIT28JUL09CLUS1910__17 | 910 | Constitutive 3' UTR |
| T-SETIT-28JUL09-CLUS1910__18 | 911 | Constitutive 3' UTR |
| T-SETIT-28JUL09-CLUS1910__19 | 912 | Constitutive 3' UTR |
| T-SETIT-28JUL09-CLUS2157__4 | 913 | Constitutive 3' UTR |
| T-SETIT-28JUL09-CLUS2166__1 | 914 | Constitutive 3' UTR |

TABLE 23-continued

Transcription termination or 3' UTR elements derived from *S. italica*.

| Annotation | SEQ ID NO: | Description |
| --- | --- | --- |
| T-SETIT-28JUL09-CLUS243_3 | 915 | Constitutive 3' UTR |
| T-SETIT-28JUL09-CLUS3485_1 | 916 | Constitutive 3' UTR |
| T-SETIT-28JUL09-CLUS364_1 | 917 | Constitutive 3' UTR |
| T-SETIT-28JUL09-CLUS36567_1 | 918 | Constitutive 3' UTR |
| T-SETIT-28JUL09-CLUS42130_1 | 919 | Constitutive 3' UTR |
| T-SETIT-28JUL09-CLUS52844_1 | 920 | Constitutive 3' UTR |
| T-SETIT-28JUL09-CLUS7004_1 | 921 | Constitutive 3' UTR |
| T-SETIT-28JUL09-CLUS83_23 | 922 | Constitutive 3' UTR |
| T-SETIT-28JUL09-CLUS937_1 | 923 | Constitutive 3' UTR |
| T-SETIT-28JUL09-CLUS95524_1 | 924 | Constitutive 3' UTR |

The 3' UTRs of the present invention, presented as SEQ ID NOS: 268 through 276 and SEQ ID NOS: 779 through 924 are tested in transient protoplast assays. A constitutive or other type promoter is used to drive expression of a transgene such as GUS. Plant vectors are constructed using methods known in the art in which a transgene cassette is used to test the properties of the 3' UTR as well as provide transcript that can be analyzed to understand the effectiveness of the 3' UTR in controlling expression of the transgene and processing of the resulting transcript.

For transient assay of the test 3' UTR effectiveness, a base plant vector is constructed using methods known in the art. The 3' UTR is cloned into a base plant vector which comprises a first transgene cassette to test the 3' UTR comprised of, a constitutive promoter such as the Cauliflower mosaic virus promoter, P-CaMV.35S-enh-1:1:9 (SEQ ID NO: 1096), operably linked 5' to a leader element, L-Ta.Lhcb1-1:1:1 (SEQ ID NO: 1114), operably linked to an intron derived from the HSP70 heat shock protein of *Zea mays* (1-Zm.DnaK-1:1:1, SEQ ID NO: 1102), operably linked to a coding sequence for β-glucuronidase (GUS) that either possessed a processable intron (GUS-2, SEQ ID NO: 1091) or no intron (GUS-1, SEQ ID NO: 1090), operably linked to the Nopaline synthase 3' termination region from *A. tumefaciens* (T-AGRtu.nos-1:1:13, SEQ ID NO: 1088) or the 3' termination region from the rice lipid transfer protein gene (T-Os.LTP-1:1:1, SEQ ID NO: 1089); a second transgene selection cassette used for selection of transformed plant cells that conferred resistance to the herbicide glyphosate (driven by the rice Actin 1 transcriptional regulatory element group, SEQ ID NO: 1098), or alternatively, the antibiotic kanamycin (driven by the rice Actin 1 transcriptional regulatory element group, SEQ ID NO: 1098) and a left border region from *A. tumefaciens*.

Several experimental observations are made to characterize the 3' UTR in protoplast assay. For example, the level of expression is determined using GUS staining as described in previous examples to assess the amount of protein expressed and is normalized using methods known in the art to draw a comparison in protein expression levels of the test 3' UTR relative to the T-AGRtu.nos control. Total RNA is extracted and probed on Northern blots with probes specific to the GUS coding sequence to assess the size or sizes of transcripts produced in the protoplast cells to determine the effectiveness of the 3' UTR in terminating transcription. Alternatively, the sequence 3' of the 3' UTR can be used to prime amplification reactions from reverse transcribed RNA to detect transcripts in which read-through has occurred beyond the 3' UTR. Total RNA probed on Northern blots can also reveal the relative abundance of transcript when compared to the T-AGRtu.nos control.

Example 16

Assay of Transcriptional Termination Sequences or 3' UTRs in Stable Plants

The 3' UTRs, presented as SEQ ID NOS: 268 through 276 and SEQ ID NOS: 779 through 924 are tested in stably transformed corn plants. For stable plant assay of the 3' UTR, a GUS expression plant transformation vector is constructed using methods known in the art similar to the constructs described in the previous examples. The 3' UTR is cloned into a base plant vector which comprises a first transgene cassette to test the 3' UTR comprised of, a constitutive promoter such as the Cauliflower mosaic virus promoter, P-CaMV.35S-enh-1:1:9 (SEQ ID NO: 1096), operably linked 5' to a leader element, L-Ta.Lhcb1-1:1:1 (SEQ ID NO: 1114), or alternatively, a root promoter such as Lipid transfer protein promoter, P-Os.Rcc3-1:1:24 (SEQ ID NO: 1093), operably linked 5' to the leader, L-Os.Rcc3-1:1:2 (SEQ ID NO: 1094), operably linked to an intron derived from the HSP70 heat shock protein of *Zea mays* (I-Zm.DnaK-1:1:1, SEQ ID NO: 1102), operably linked to a coding sequence for β-glucuronidase (GUS) that either possessed a processable intron (GUS-2, SEQ ID NO: 1091) or no intron (GUS-1, SEQ ID NO: 1090), operably linked to a test 3' termination region; a second transgene selection cassette used for selection of transformed plant cells that conferred resistance to the herbicide glyphosate (driven by the rice Actin 1 transcriptional regulatory element group, SEQ ID NO: 1098), or alternatively, the antibiotic kanamycin (driven by the rice Actin 1 transcriptional regulatory element group, SEQ ID NO: 1098) and a left border region from *A. tumefaciens*.

The resulting plasmids are used to transform corn plants. Single-copy or low copy number transformants are selected for comparison to single-copy or low copy number transformed plants, transformed with a plant transformation vector identical to the test vector but comprising a well characterized 3' UTR, such as the Nopaline synthase 3' termination region from *A. tumefaciens* (T-AGRtu.nos-1:1:13, SEQ ID NO: 1088) operably linked to the GUS transgene.

Corn plants are transformed as described above or by *Agrobacterium*-mediated transformation methods known in the art. Tissue is harvested at different time points of development and from different organs and assayed for GUS activity to assess the amount of protein expressed in each tissue at different time windows of development and is compared to expression of GUS in control transformed plants. Total RNA is extracted from the different tissues of interest and probed on Northern blots with probes specific to the GUS coding sequence to assess the size or sizes of transcripts produced within each of the selected tissues to determine the effectiveness of the 3' UTR in terminating transcription and the relative abundance of message in each selected tissue. Alternatively, the sequence 3' of the 3' UTR can be used to prime amplification reactions from reverse transcribed RNA to detect transcripts in which read-through has occurred beyond the 3' UTR or assess the amount of transcript expressed in each tissue. The most useful and effective 3' UTRs are selected for use in transgene cassettes in which genes of agronomic importance are expressed.

Example 17

Analysis of 3' UTR-Mediated Enhancement of GUS Activity in Transgenic Corn Plants Plant binary vectors are constructed using methods known in the art similar to those described in the previous example and used to transform corn plants to test the effectiveness of selected 3' UTRs.

Plant transformation vectors are used to transform corn plants to test the effectiveness in controlling expression of the GUS transgene, when driven by either a constitutive promoter, (P-FMV.35S-enh-1:1:1 (SEQ ID NO: 1115)+L-Ta.Lhcb1-1:1:1 (SEQ ID NO: 1114)) or an enhanced root promoter, ((E-CaMV.35S-enh-1:1:1 (SEQ ID NO: 1116)+P-Os.Rcc3-1:1:24 (SEQ ID NO: 1093)+L-Os.Rcc3-1:1:2 (SEQ ID NO: 1094)). The resulting plant expression vectors contains a right border region from *Agrobacterium tumefaciens*, a first transgene cassette to test the 3' UTR comprised of a either a constitutive promoter, (P-FMV.35S-enh-1:1:1 (SEQ ID NO: 1115)+L-Ta.Lhcb1-1:1:1 (SEQ ID NO: 1114)) or an enhanced root promoter, ((E-CaMV.35S-enh-1:1:1 (SEQ ID NO: 1116)+P-Os.Rcc3-1:1:24 (SEQ ID NO: 1093)+L-Os.Rcc3-1:1:2 (SEQ ID NO: 1094)), operably linked 5' to a coding sequence for β-glucuronidase (GUS) that possesses a processable intron (GUS-2, SEQ ID NO: 1091) operably linked to the test 3' UTR; a second transgene selection cassette used for selection of transformed plant cells that confers resistance to the herbicide glyphosate (driven by the rice Actin 1 promoter), and a left border region from *A. tumefaciens*. Table 24 below shows the test constructs and the corresponding promoter and 3' UTR.

TABLE 24

Transcriptional termination or 3' UTR test constructs in which GUS is driven either by a constitutive promoter or an enhanced root promoter.

| Test 3' UTR | Constitutive Constructs P-FMV.35S-enh-1:1:1 (SEQ ID NO: 1115) L-Ta.Lhcb1-1:1:1 (SEQ ID NO: 1114) | Enhanced Root Constructs E-CaMV.35S-enh-1:1:1 (SEQ ID NO: 1116) P-Os.Rcc3-1:1:24 (SEQ ID NO: 1093) L-Os.Rcc3-1:1:2 (SEQ ID NO: 1094) |
|---|---|---|
| T-SETit.Ntr-1:1:1 (SEQ ID NO: 275) | pMON126964 | pMON126965 |
| T-SETit.Sus2-1:1:1 (SEQ ID NO: 276) | pMON126966 | pMON126967 |
| T-SETit.Ctpt-1:1:2 (SEQ ID NO: 271) | pMON126968 | pMON126969 |
| T-SETit.Fnr-1:1:1 (SEQ ID NO: 273) | pMON126974 | pMON126975 |
| T-SETit.Mes2-1:1:1 (SEQ ID NO: 274) | pMON126976 | pMON126977 |
| T-SETit.Fba-1:1:1 (SEQ ID NO: 272) | pMON126978 | pMON126979 |
| T-SETit.Act8-1:1:1 (SEQ ID NO: 269) | pMON127033 | |
| T-SETit.Act1-1:1:1 (SEQ ID NO: 268) | pMON127035 | |
| T-SETit.Ams1-1:1:1 (SEQ ID NO: 270) | pMON127041 | |

Corn plants are transformed using *Agrobacterium*-mediated methods known in the art and as described in the previous examples. Transformed corn plants are assayed for GUS activity as described in the previous examples. Tables 25 and 26 show the average level of GUS expression observed in various tissues isolated from the transformed plants in which the constitutive promoter, ((P-FMV.35S-enh-1:1:1 (SEQ ID NO: 1115)+L-Ta.Lhcb1-1:1:1 (SEQ ID NO: 1114)), drove expression of the GUS transgene. Tables 27 and 28 show the average level of GUS expression observed in tissues isolated from the transformed plants in which the enhanced root promoter, ((E-CaMV.35S-enh-1:1:1 (SEQ ID NO: 1116)+P-Os.Rcc3-1:1:24 (SEQ ID NO: 1093)+L-Os.Rcc3-1:1:2 (SEQ ID NO: 1094)), drove expression of the GUS transgene. Enhancement of expression imparted by the 3' UTR is inferred by the relative comparison amongst the constructs transformed comprising each UTR and specific promoter.

TABLE 25

Average $R_0$ GUS expression of a constitutive promoter driving GUS with different 3' UTRs.

| Construct | 3' UTR Annotation | V3 Root | V7 Root | VT Root | V3 Leaf | V7 Leaf | VT Leaf |
|---|---|---|---|---|---|---|---|
| pMON126964 | T-SETit.Ntr-1:1:1 (SEQ ID NO: 275) | 45.54 | 136.70 | 103.51 | 112.24 | 151.17 | 304.15 |
| pMON126966 | T-SETit.Sus2-1:1:1 (SEQ ID NO: 276) | 12.01 | nd | 123.25 | 33.30 | 140.51 | 100.88 |
| pMON126968 | T-SETit.Ctpt-1:1:2 (SEQ ID NO: 271) | 9.76 | nd | 108.38 | 231.03 | 417.04 | 157.53 |
| pMON126974 | T-SETit.Fnr-1:1:1 (SEQ ID NO: 273) | 7.74 | nd | 53.30 | 163.74 | 357.60 | 456.63 |
| pMON126976 | T-SETit.Mes2-1:1:1 (SEQ ID NO: 274) | nd | nd | 454.44 | 235.62 | 268.63 | 235.73 |
| pMON126978 | T-SETit.Fba-1:1:1 (SEQ ID NO: 272) | nd | 158.85 | 45.89 | 60.97 | 250.87 | 121.41 |
| pMON127033 | T-SETit.Act8-1:1:1 (SEQ ID NO: 269) | nd | nd | 203.77 | 129.06 | 240.13 | 460.74 |
| pMON127035 | T-SETit.Act1-1:1:1 (SEQ ID NO: 268) | 117.02 | 174.21 | 557.50 | 412.92 | 511.88 | 531.34 |

TABLE 25-continued

Average R₀ GUS expression of a constitutive promoter driving GUS with different 3' UTRs.

| Construct | 3' UTR Annotation | V3 Root | V7 Root | VT Root | V3 Leaf | V7 Leaf | VT Leaf |
|---|---|---|---|---|---|---|---|
| pMON127041 | T-SETit.Ams1-1:1:1 (SEQ ID NO:270) | 842.04 | 564.84 | 246.90 | 986.33 | 225.68 | 279.58 |

The average expression of the GUS gene was effected by different 3' UTRs. GUS expression driven by the constitutive promoter appeared to be affected by the use of different 3' UTRs, particularly with respect to leaf expression. An enhancement of leaf expression at V3 and V7 stage could be seen when the 3' UTR, T-SETit.Ctpt-1:1:2 (SEQ ID NO: 271) was used in combination with the constitutive promoter. Enhancement was provided for all 3 leaf stages when combining the constitutive promoter with the 3' UTRs, T-SETit.Mes2-1:1:1 (SEQ ID NO: 274), T-SETit.Act1-1:1:1 (SEQ ID NO: 268) and T-SETit.Ams1-1:1:1 (SEQ ID NO: 270). Enhancement of expression in the root using the constitutive promoter was observed through out all 3 stages using the 3' UTR, T-SETit.Ams1-1:1:1 (SEQ ID NO: 270) and at VT stage using the 3' UTRs, T-SETit.Mes2-1:1:1 (SEQ ID NO: 274), T-SETit.Act8-1:1:1 (SEQ ID NO: 269) and T-SETit.Act1-1:1:1 (SEQ ID NO: 268).

Enhancement of GUS expression in the anther and pollen when using a constitutive promoter could be observed for the 3' UTRs, T-SETit.Fnr-1:1:1 (SEQ ID NO: 273), T-SETit.Mes2-1:1:1 (SEQ ID NO: 274), T-SETit.Act8-1:1:1 (SEQ ID NO: 269), T-SETit.Act1-1:1:1 (SEQ ID NO: 268) and T-SETit.Ams1-1:1:1 (SEQ ID NO: 270). Enhancement of GUS expression in the endosperm when using a constitutive promoter could be observed for the 3' UTR, T-SETit.Sus2-1:1:1 (SEQ ID NO: 276). Enhancement of GUS expression in the embryo when using a constitutive promoter could be observed in most of the 3' UTRs relative to the lowest expressor, T-SETit.Ntr-1:1:1 (SEQ ID NO: 275). The greatest amount of enhancement in embryo was observed using the 3' UTRs, T-SETit.Mes2-1:1:1 (SEQ ID NO: 274) and T-SETit.Act1-1:1:1 (SEQ ID NO: 268).

Readthrough was assessed using PCR methods known in the art. Those 3' UTRs demonstrating some readthrough in assay were T-SETit.Ntr-1:1:1 (SEQ ID NO: 275), T-SETit.Sus2-1:1:1 (SEQ ID NO: 276), T-SETit.Ctpt-1:1:2 (SEQ ID NO: 271), T-SETit.Mes2-1:1:1 (SEQ ID NO: 274) and T-SETit.Act1-1:1:1 (SEQ ID NO: 268). Those 3' UTRs in

TABLE 26

Average R₀ GUS expression of a constitutive promoter driving GUS with different 3' UTRs.

| Construct | 3' UTR Annotation | VT Anther | VT Silk | 21 DAP Embryo | 21 DAP Endosperm |
|---|---|---|---|---|---|
| pMON126964 | T-SETit.Ntr-1:1:1 (SEQ ID NO: 275) | 140.38 | 96.86 | 36.85 | 139.47 |
| pMON126966 | T-SETit.Sus2-1:1:1 (SEQ ID NO: 276) | 166.05 | 110.71 | 275.98 | 223.52 |
| pMON126968 | T-SETit.Ctpt-1:1:2 (SEQ ID NO: 271) | 219.71 | 101.88 | 72.49 | 235.36 |
| pMON126974 | T-SETit.Fnr-1:1:1 (SEQ ID NO: 273) | 350.21 | 419.08 | 107.48 | 243.22 |
| pMON126976 | T-SETit.Mes2-1:1:1 (SEQ ID NO: 274) | 401.38 | 370.21 | 174.26 | 366.92 |
| pMON126978 | T-SETit.Fba-1:1:1 (SEQ ID NO: 272) | 41.62 | 59.81 | 115.59 | 168.81 |
| pMON127033 | T-SETit.Act8-1:1:1 (SEQ ID NO: 269) | 324.04 | 435.63 | 133.10 | 262.52 |
| pMON127035 | T-SETit.Act1-1:1:1 (SEQ ID NO: 268) | 408.61 | 707.00 | 119.39 | 419.52 |
| pMON127041 | T-SETit.Ams1-1:1:1 (SEQ ID NO: 270) | 346.60 | 246.92 | 134.79 | 251.23 | which readthrough was not observed were T-SETit.Fnr-1:1:1 (SEQ ID NO: 273), T-SETit.Fba-1:1:1 (SEQ ID NO: 272), T-SETit.Act8-1:1:1 (SEQ ID NO: 269) and T-SETit.Ams1-1:1:1 (SEQ ID NO: 270).

TABLE 27

Average R₀ GUS expression of an enhanced root promoter driving GUS with different 3' UTRs.

| Construct | 3' UTR Annotation | V3 Root | V7 Root | VT Root | V3 Leaf | V7 Leaf | VT Leaf |
|---|---|---|---|---|---|---|---|
| pMON126965 | T-SETit.Ntr-1:1:1 (SEQ ID NO: 275) | 7.86 | 11.39 | 8.34 | 0.00 | 5.60 | 8.89 |
| pMON126967 | T-SETit.Sus2-1:1:1 (SEQ ID NO: 276) | 67.45 | 44.80 | 8.98 | 0.00 | 0.00 | 0.00 |

TABLE 27-continued

Average R₀ GUS expression of an enhanced root promoter driving GUS with different 3' UTRs.

| Construct | 3' UTR Annotation | V3 Root | V7 Root | VT Root | V3 Leaf | V7 Leaf | VT Leaf |
|---|---|---|---|---|---|---|---|
| pMON126969 | T-SETit.Ctpt-1:1:2 (SEQ ID NO: 271) | 35.07 | 28.96 | 6.28 | 7.44 | 5.07 | 0.00 |
| pMON126975 | T-SETit.Fnr-1:1:1 (SEQ ID NO: 273) | 45.53 | 12.99 | 10.67 | 81.88 | 0.00 | 0.00 |
| pMON126977 | T-SETit.Mes2-1:1:1 (SEQ ID NO: 274) | 16.64 | 50.03 | 23.55 | 0.00 | 20.47 | 0.00 |
| pMON126979 | T-SETit.Fba-1:1:1 (SEQ ID NO: 272) | 30.95 | 19.79 | 14.22 | 0.00 | 7.47 | 0.00 |

Using an enhanced root promoter, enhancement in root at V3 and V7 stage was observed using the 3' UTR, T-SETit-.Sus2-1:1:1 (SEQ ID NO: 276). Slight enhancement of root expression could also be observed when using the 3' UTRs, T-SETit.Ctpt-1:1:2 (SEQ ID NO: 271) (V3 and V7 stage), T-SETit.Fnr-1:1:1 (SEQ ID NO: 273) (V3 stage) and T-SETit.Fba-1:1:1 (SEQ ID NO: 272) (V3 stage). An enhancement of leaf expression was observed when using the enhanced root promoter in combination with T-SETit.Fnr-1:1:1 (SEQ ID NO: 273).

TABLE 28

Average R₀ GUS expression of an enhanced root promoter driving GUS with different 3' UTRs.

| Construct | 3' UTR Annotation | VT Anther | VT Silk | 21 DAP Embryo | 21 DAP Endosperm |
|---|---|---|---|---|---|
| pMON126965 | T-SETit.Ntr-1:1:1 (SEQ ID NO: 275) | 6.59 | 5.16 | 0.00 | 0.00 |
| pMON126967 | T-SETit.Sus2-1:1:1 (SEQ ID NO: 276) | 12.24 | 0.00 | 115.97 | 21.68 |
| pMON126969 | T-SETit.Ctpt-1:1:2 (SEQ ID NO: 271) | 0.00 | 0.00 | 7.20 | 10.77 |
| pMON126975 | T-SETit.Fnr-1:1:1 (SEQ ID NO: 273) | 5.71 | 12.57 | 7.60 | 0.00 |
| pMON126977 | T-SETit.Mes2-1:1:1 (SEQ ID NO: 274) | 7.28 | 0.00 | 0.00 | 5.18 |
| pMON126979 | T-SETit.Fba-1:1:1 (SEQ ID NO: 272) | 11.25 | 0.00 | 0.00 | 8.38 |

Enhancement of expression in the embryo was observed for the 3' UTR, T-SETit.Sus2-1:1:1 (SEQ ID NO: 276) when combined with the enhanced root promoter. The 3' UTR elements presented above each had an effect on expression of GUS when combined in operable linkage with ether a constitutive promoter or an enhanced root promoter.

Example 18

Identification and Assay of Chloroplast Transit Peptides (CTPs)

It is well known that the cells of eukaryotic organisms, and more particularly plant cells, contain distinct sub-cellular compartments, or organelles, delimited by characteristic membrane systems and performing specialized functions within the cell. In photosynthetic leaf cells of higher plants the most conspicuous organelles are the chloroplasts, which exist in a semi-autonomous fashion within the cell, containing their own genetic system and protein synthesis machinery, but relying upon a close cooperation with the nucleo-cytoplasmic system in their development and biosynthetic activities.

Most chloroplast proteins are coded for in the nuclear DNA and are the products of protein synthesis on cytoplasmic ribosomes, many as soluble higher molecular weight precursors. These precursors are then translocated through either one or both of the plastid envelope membranes, processed, and assembled into their final organellar compartment or holoenzyme complex. In vitro reconstitution experiments using isolated chloroplasts, have demonstrated that the uptake and processing of over one hundred nuclear-encoded, cytoplasmically synthesized precursors by chloroplasts occurs by an energy-dependent, post-translational mechanism.

The most extensively characterized of these nuclear-encoded chloroplast proteins is the small subunit of ribulose-1,5-bisphosphate (RuBP) carboxylase. This polypeptide is synthesized on free cytoplasmic ribosomes as a precursor of 20,000 daltons containing an amino terminal extension or transit peptide of approximately 5-6,000 daltons. During or immediately after import of the precursor into the chloroplast, the transit peptide is proteolytically removed in two steps by a soluble protease, yielding a mature small subunit polypeptide of 15,000 daltons. This polypeptide is then assembled with an endogenous large subunit into the functional RuBP carboxylase holoenzyme.

These different properties of the transit peptides are at the basis of the recombinant DNAs, more particularly recombinant vectors including a DNA sequence coding for a determined protein or polypeptide, particularly a foreign protein, sought to be introduced and processed in chloroplasts, as well as the processes for the introduction of such foreign polypeptide or protein into the chloroplasts, for instance in the thylacoid membranes or, preferably, in the stroma thereof.

Chloroplast transit peptides (CTPs) are isolated from S. italica based upon an analysis of EST cluster sequences and homology to known plastid targeted molecules. Clusters of EST sequences are used to deduce the coding sequence of chloroplast targeted protein molecules. A fragment derived from the 5' end of the coding sequence of the deduced chloroplast targeted molecule is cloned using methods known in the art to produce a chimeric molecule in which a coding sequence encoding a non-chloroplast targeted molecule is fused in frame at the 5' end with a DNA fragment encoding the putative transit peptide sequence and cloned into a plant expression vector to determine the ability and efficiency of the putative CTP to cause importation of the chimeric molecule into the chloroplast and subsequent processing of the transit peptide sequence into the mature, processed protein.

Translated S. italica EST sequence clusters are compared with DNA sequences encoding known plastid targeted molecules from monocots such as corn, sorghum and rice to determine the completeness of the cluster coding sequence and deduce the potential N-terminal amino acid sequence that will be useful as a transit peptide coding sequence. In some instances, the 5' most portion of the *S. italica* EST cluster is absent. In those conditions, a degenerate oligo is designed based upon an alignment of sorghum and rice coding sequences, encoding homologs to the *S. italica* protein coding sequence to facilitate amplification of the unknown 5' sequence.

Sequences encoding plastid targeted proteins useful in isolating and cloning *S. italica* CTPs are presented as SEQ ID NOS: 1034 through 1060. Protein sequences representing plastid targeted peptides useful in identification of *S. italica* CTPs are presented as 1061 through 1087. Nucleotide sequences encoding transit peptides shown in Table 29 below are presented as SEQ ID NOS: 277 through 284, 289 through 293, 296, 301 through 304 and 307 through 316. Protein sequences of the encoded transit peptides are presented as SEQ ID NOS: 324 through 350.

Constructs for use in cloning the transit peptides and sequences encoding the transit peptide as well as the transit peptide sequence IDs are presented in Table 29 below.

TABLE 29

Plasmid constructs for use in cloning chloroplast transit peptides and associated protein and nucleotide coding sequences.

| Construct | Annotation | Protein SEQ ID NO: | Nucleotide SEQ ID NO: | Description |
|---|---|---|---|---|
| pMON136303 | GOI-TS-APX | 325 | 277 | Ascorbate Peroxidase |
| pMON139282 | GOI-TS-APX:1:2 | 325 | 278 | Ascorbate Peroxidase |
| pMON139283 | GOI-TS-APX2:1:1 | 326 | 279 | Ascorbate Peroxidase |
| pMON139281 | GOI-TS-CNT:1:2 | 332 | 280 | 2-C-methyl-D-erythritol 4-phosphate cytidylyltransferase |
| pMON139291 | GOI-TS-DHDPS:1:2 | 334 | 281 | Dihydrodipicolinate synthase precursor, chloroplastic |
| pMON139288 | GOI-TS-Fe-SD:1:1 | 335 | 282 | Iron-superoxidedismutases, chloroplastic |
| pMON139287 | GOI-TS-PPR:1:1 | 340 | 283 | Pentatricopeptide repeat-containing protein, putative |
| pMON139276 | TS-SETit.APG6-1:1:1 | 324 | 284 | Casein lytic proteinase B3 heat shock protein-like |
| pMON139284 | TS-SETit.APX3-1:1:1 | 327 | 289 | Ascorbate Peroxidase |
| pMON139278 | TS-SETit.ASA2-1:1:1 | 328 | 290 | Anthranilate Synthase alpha 2 subunit |
| pMON139285 | TS-SETit.CC10-1:1:1 | 329 | 291 | Chloroplast Chaperonin 10 Kd subunit |
| pMON136299 | TS-SETit.CHoR1-1:1:1 | 330 | 292 | Calcium homeostasis regulator |
| pMON139280 | TS-SETit.ClpD-1:1:1 | 331 | 293 | ATP-dependent Clp protease ATP-binding subunit |
| pMON136296 | TS-SETit.CR88-1:1:1 | 333 | 296 | Heat-shock protein putative |
| pMON139290 | TS-SETit.G-typA-1:1:1 | 336 | 301 | GTP-binding protein typA |
| pMON136301 | TS-SETit.HDh-1:1:1 | 337 | 302 | Haloacid dehalogenase-like hydrolase |
| pMON139289 | TS-SETit.IMP-1:1:1 | 338 | 303 | Inositol-1-monophosphatase, putative, chloroplastic |
| pMON136297 | TS-SETit.MDH-1:1:1 | 339 | 304 | Putative NAD-malate dehydrogenase |
| pMON136302 | TS-SETit.PSPR-3-1:1:1 | 341 | 307 | Plastid-specific 30S ribosomal protein 3 |
| pMON136291 | TS-SETit.RbcS_1-1:1:1 | 342 | 308 | Small subunit RUBISCO |
| pMON136292 | TS-SETit.RbcS_2-1:1:1 | 343 | 309 | Small subunit RUBISCO |
| pMON136293 | TS-SETit.RbcS_3-1:1:1 | 344 | 310 | Small subunit RUBISCO |
| pMON136294 | TS-SETit.RbcS_4-1:1:1 | 345 | 311 | Small subunit RUBISCO |
| pMON139277 | TS-SETit.ShkG-1:1:1 | 346 | 312 | 5-enolpyruvylshikimate-3-phosphate synthase precursor |
| pMON139286 | TS-SETit.SRP43-1:1:1 | 347 | 313 | Signal recognition particle 43 kDa protein, chloroplastic |

TABLE 29-continued

Plasmid constructs for use in cloning chloroplast transit peptides and associated protein and nucleotide coding sequences.

| Construct | Annotation | Protein SEQ ID NO: | Nucleotide SEQ ID NO: | Description |
|---|---|---|---|---|
| pMON139279 | TS-SETit.TDh-1:1:1 | 348 | 314 | Threonine dehydratase biosynthetic, chloroplast precursor |
| pMON136304 | TS-SETit.ThR-1:1:1 | 349 | 315 | Thioredoxin |
| pMON136287 | TS-SETit.Wx1-1:1:1 | 350 | 316 | Putative granule bound starch synthase |

The transit peptide encoding sequences presented as SEQ ID NOS: 325, 326, 332, 334, 335 and 340 are derived and cloned from DNA sequences comprising a processable intron. The plasmids construct pMON136303 is comprised of the transit peptide encoding sequence, GOI-TS-APX, presented as SEQ ID NO: 277, which is further comprised of the element, TS-SETit.APX.ex1-1:1:1 (SEQ ID NO: 286), operably linked 5' to the intron element, I-SETit.APX-1:1:1 (SEQ ID NO: 318), operably linked 5' to the element, TS-SETit.APX.ex2-1:1:2 (SEQ ID NO: 287). The plasmids construct pMON139282 is comprised of the transit peptide encoding sequence, GOI-TS-APX:1:2, presented as SEQ ID NO: 278, which is further comprised of the element, TS-SETit.APX.ex1-1:1:1 (SEQ ID NO: 286), operably linked 5' to the intron element, I-SETit.APX-1:1:2 (SEQ ID NO: 319), operably linked 5' to the element, TS-SETit.APX.ex2-1:1:2 (SEQ ID NO: 287). The plasmids construct pMON139283 is comprised of the transit peptide encoding sequence, GOI-TS-APX2:1:1, presented as SEQ ID NO: 279, which is further comprised of the element, TS-SETit.APX.2.ex1-1:1:1 (SEQ ID NO: 285), operably linked 5' to the intron element, I-SETit.APX.2-1:1:1 (SEQ ID NO: 317), operably linked 5' to the element, TS-SETit.APX2.ex2-1:1:1 (SEQ ID NO: 288). The plasmids construct pMON139281 is comprised of the transit peptide encoding sequence, GOI-TS-CNT:1:2, presented as SEQ ID NO: 280, which is further comprised of the element, TS-SETit.CNT.ex1-1:1:1 (SEQ ID NO: 294), operably linked 5' to the intron element, I-SETit.CNT.1-1:1:1 (SEQ ID NO: 320), operably linked 5' to the element, TS-SETit.CNT.ex2-1:1:2 (SEQ ID NO: 295). The plasmids construct pMON139291 is comprised of the transit peptide encoding sequence, GOI-TS-DHDPS:1:2, presented as SEQ ID NO: 281, which is further comprised of the element, TS-SETit.DHDPS.Ex1-1:1:1 (SEQ ID NO: 297), operably linked 5' to the intron element, I-SETit.DHDPS_1-1:1:1 (SEQ ID NO: 321), operably linked 5' to the element, TS-SETit.DHDPS.Ex2-1:1:1 (SEQ ID NO: 298). The plasmids construct pMON139288 is comprised of the transit peptide encoding sequence, GOI-TS-Fe-SD:1:1, presented as SEQ ID NO: 282, which is further comprised of the element, TS-SETit.Fe-SD.ex1-1:1:1 (SEQ ID NO: 299), operably linked 5' to the intron element, I-SETit.Fe-SD-1:1:1 (SEQ ID NO: 322), operably linked 5' to the element, TS-SETit.Fe-SD.ex2-1:1:1 (SEQ ID NO: 300). The plasmids construct pMON139287 is comprised of the transit peptide encoding sequence, GOI-TS-PPR:1:1, presented as SEQ ID NO: 283, which is further comprised of the element, TS-SETit.PPR.ex1-1:1:1 (SEQ ID NO: 305), operably linked 5' to the intron element, I-SETit.PPR-1:1:2 (SEQ ID NO: 323), operably linked 5' to the element, TS-SETit.P-PR.ex2-1:1:2 (SEQ ID NO: 306).

Isolated coding sequences encoding *S. italica* CTPs are tested using plant vectors designed for use in either transient protoplast or stable transformation plant assays. DNA fragments encoding the CTP are cloned in frame with a GUS coding sequence using methods known in the art. A plant transformation vector is constructed using methods known in the art and is comprised in a similar manner as the plant vectors described in the previous examples. The expression cassette used to test the CTP is comprised of a constitutive promoter such as the Cauliflower mosaic virus promoter, P-CaMV.35S-enh-1:1:9 (SEQ ID NO: 1096), operably linked 5' to a leader element, L-Ta.Lhcb1-1:1:1 (SEQ ID NO: 1097), operably linked 5' to a coding sequence for GFP in which the test CTP is fused in frame at the 5' end of the GFP coding sequence to enable translation of a chimeric CTP-GFP molecule, operably linked to the Nopaline synthase 3' termination region from *A. tumefaciens* (T-AGRtu-.nos-1:1:13, SEQ ID NO: 1088). For stable plant transformation, a second transgene selection cassette used for selection of transformed plant cells that confers resistance to the herbicide glyphosate (driven by the rice Actin 1 promoter) is cloned adjacent to the CTP test transgene cassette. The two transgene cassettes are flanked at the by a right border and left border region from *Agrobacterium tumefaciens* to allow for stable integration of both transgene cassettes in the plant cell genome.

For transient assay testing of the CTP, protoplast cells are transformed with the plant plasmid construct comprising the CTP test transgene cassette. Transformed protoplast cells are observed using microscopy and fluorescence to determine the relative amount of GFP protein present in the chloroplast and in the cytosol. An effective CTP will cause most GFP fluorescence to appear in the chloroplast stroma or thylacoid, depending upon the type of CTP chosen. Protein is isolated and electrophoresed on polyacrylamide gels and stained using standard methods and compared with a non-plastid targeted GFP protein standard to determine if proper processing of the transit peptide has occurred.

For stable plant transformation, corn plants are transformed as described above by using *Agrobacterium*-mediated transformation methods known in the art. Tissues are harvested from the developing transformants and viewed microscopically with fluorescence to determine the relative amounts of GFP protein in the chloroplast and cytosol. Protein is isolated and electrophoresed on polyacrylamide gels and stained using standard methods and compared with a non-plastid targeted GFP protein standard to determine if proper processing of the transit peptide has occurred.

Having illustrated and described the principles of the present invention, it should be apparent to persons skilled in the art that the invention can be modified in arrangement and detail without departing from such principles. We claim all

SEQUENCE LISTING (1117 sequences)

SEQ ID NO: 1 - DNA, 1752 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagcgtttaatcatattttcttcgttccgttccgacaccaaaagcgagagttgatgatagctgggcgatgcttgtgccttgtgcgtttggctgggcctggtgcgccggcgtgcagatcggaggagggcgttgcgtgcccgcggcacgtatgcaacagcaacgcaaatggagccccgacagcgccgtgtatgcttgcacccaacgtctcgacgaccacgcggcacggcacgcaaaaaatctggccccggcctctgtcgcacagatctgtccaacatctcctgttcgtatgatccccctcgtgaatgcgatgcttgctaacactaaataaggtttcccctttttcctttttgcggggaaaagaattgaatgtttccctttgaaccgtgcacgccgcactgatccagccctgctcaccgggactaaaatatcgtcgccggctgactttacactacacccacccacccgtcgaccatcgccatcgacgaggtaaacagcaaagcaaaagataatcccggcctccaaacgcgtcatcggccacttgggcttgggccactcgcagggaaaaatcgtgccgaatccacatcgaccctcctatttgctattcctaccgtgcccgcgccttcgctgaacgtctcctaccccctgcgcttcttggaacgaccgcaccaacaccagagcaagggcgcagccactggccacttgttacgcaaaagaatcctatccacgacaggcggatcggggagtgggtaggtcgcggcaggtggcggtggcggtggtaggaatgaaccccgggatcgtgcgtttgtggactgccacaacgacgggtgctcgatccatgtgttctcctcaatcaaaaaagaataaaaaaaacgttaatagaatggaaaaggtgaatgcttgaggaggtttggtgggtcaacagcaacatgagagggaaatgtctttggtttccaggaaggagagagttggtgagagcgccggagtgtaaagtctaaggcactcgcctttgctttatacgaaggttaggaataatagtgccgagagcaatcaggcaacacacaccaaccctgctaaactcccgggcctcccagctcataaatagagtatcgctgcgaggccgagcagtgggcgaccctgtgagcttagctagcaagcaatcaagcactgccacctgcaacctcacggagaaagttaaggcggcgagagacagagagatcc

SEQ ID NO: 2 - DNA, 2303 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagggatgatggattgcttttgagaatgacttcttaaagcgtcaagcttttctgactgtgtcaggtcagcttcaggttgaaacttatgcttgtgctctcagtagtgtatatacctttggaccaacgttccgggcagagaactcacatacatcaagacatctggcagagttttggatggttgaaccagaaaatgcatttgcaaacttgcaggtgagctgcttcttgatgactaactttattactttgtggttcgccacctatcaaattggatcatggggttttgtgtggacataactaatgttaaacttgtataaattgtgtcacaggatgatatgaactgtgcagaaaaatatgtacaatacctctgccagtggttactcgatcattgtgaagaagacatagatttcattagcaaaaaatacgagagaaacagtagacataatcaaactgcaattgaccgtctgaagcttgtttcctcaacgcattttgaacgtatttcatacacaatggctgtggacattctgaaaaatacagaacaaggttgaatggggaatcgatttagcatctgagcatgaaaggtatgtgcaagttgtcagttgatcttactggtcttcacctgatttaccttctttgattggttaactgtaactacgtattctgtgaaggtatttgactgaggtgatatataagaagccagttattgtttataactatcccaaagaaataaaagcattttatatgaggctcaatgatgatcagaagactgtttctgctatggatgttcttgcgccacaggtatagatcgaattgttgaaatgtctatgatgctgtccattgttcactgaagtgccccacaccattctaccctcaatcagcatggatataagcagccagattcatgtctgctcttagtagaatataactatttctttctgccttttagaatttagatatctctggattcttttttcgccttttcaccaattacaaagaactaaaactgcatataactatattaagataacaatatttacattttctgaaatagctgtatgcttgcaactacatgctggatattttgctttgcctgctttgtatatagtttgaaagtgagctttgtggccgatgatttctacctaaccataaattattttccttggtaggttggtgaattgactggtggaagccagaggagcatctagatgtcctgaaacagaggtaccgacttgctcaatataattttgtttctatcaggatcaatattaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcatcgttgatatctcttgcagcgttgggtctctgtcacacacacaggaagcacaggaagctaagctagcagtcgcgagagagcgagcg

SEQ ID NO: 3 - DNA, 1050 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagcaggatttaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcatcgttgatatctcttgcagcgttgggtctctgtcacacacacaggaagcacaggaagctaagctagcagtcgcgagagagcgagcg

SEQ ID NO: 4 - DNA, 898 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagcctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacgagatttgcagcgcacactgagcgagtacttggcaggccgatcagctcgttgatagcaagctcactcgtcagtaagtagcaatcagg

SEQ ID NO: 5 - DNA, 1971 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaaggcgcagagtcacggcgtactagtcagctgccgagaggatggatgggatcatcgatcatgccaggatcgtcgtcgtttccttgacagtttttgaccttttgcgtcatgccgccccgagtcgtcaccattgcttgtgtctccttacgtggaaaattccatgaaccggccgaatagctttgtcgcaactgagctgaaaaaggagactgaaaatgatacaagtacttgatgtttggtgcgagatagacatcaccttttgaacggatcaattagtagtttgcagcgcaaacagacgattgaaaatgcaagcctgccagctgcactgatgggaaaagggcatcctaattcctgttcaaataaagggcatgattagcgggatactactacccatcatcttgtgcaaatttcttgagatgcttgtactgtttctgactgccgttggcgtctgacagcgagatgctgtgtgctgcagcagcaactctacggtgatattttccgtcgccatgcagtttttttcccgtgtggtaacaaaatacaagatttcctgtcgtcgccatacacttcaaaggtctagaaattaataaagcgaactctattttggaatgtttcgatgggactataacgattttctgaacgtctccagtactgatggttctaactgtcaaaattaaacttgtcgctttatcaatgtcttgactgccggtaactgacagatagtaacctatgcaagctttagtcaagaaacggagataagcacaactcagccacttgcacatcgcaatcactcggatcagttatagacctttctcacaggatttcaaccccagacaaattttgcatggctggcatggttgcattgcaggctaacaaccacgtgttgagtggagaaattgatgagatgccttcaggcttccttattctgaatattacatgtttttgtgctcttgtatctccttacctaatcgaacagaaaaggtgcagcaggagagccaaattctggtttgcgccaacaagaaagagagagagccagaatttgacaggcatgcttgattattctatattaaatcttatctggcatgcttgacaggaccagcaaatgttaaaaagatatgaaccgtacattgaagattgtgatgtctctaaaacatacagtatatgtcctccctagcctgcaagcactcgttcgtttaccattataatttggagactcgaaccatcttcatatgatgcatgacaaactaaccactcattactgatcgccaacaaacatgcatgcagctcacaccgctagcaaacagcaagacatgttaccaacagactgtcacgggcgcaaaaatgatcaaacgtgcaggctactatatatacgcaatatgcaatgcatgatattcaggccatcgatcgcaaacacttgaaaaggattgtagtagtgctactagtc

SEQ ID NO: 6 - DNA, 2167 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttagcgatcaagttaattttgtttctgctttgtgcgcctgtgttccagtaattactttccgtgtagcaaaa

SEQ ID NO: 7 - DNA, 1519 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaaggtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttagcgatcaagttaattttgtttctgctttgtgcgcctgtgttccagtaattactttccgtgtagcaaaa

SEQ ID NO: 8 - DNA, 1518 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagtgtactgtcatattgtcgtggtttttcaattgctgtacctgatgcaaacgtaatgggtttactaatcttgcacccgccggcttcaaaatgaagagtgctaatttggtccacgtcaccatcaccggttcgaactgtctagaatggcaggcaaagatgattggacaggcatgcagggaaaaagagcaccgttgacgatgtatgcgagttcccaccattgcgagcaatgattatcagccacacgacttactcttcagagctaaccactgccatgcagagaaaaagtgaatcatattgtcatgatctacaacgaagtgaaacaatcaggcatgctaaagtgctgaaactttactgatctctcatgttggacaacaaagaatacgggaatacatcagcaacgcaactcttgagctttgcttgccgaatgaccagctagaatttccaagcatttacagaaacatgactttaagtttcagaaaaacaaatacaaggccactaaataagcgtggggataacatatcctccagatgacaggcaatctgcaacttgcagccattcaaatgtacgattaacaaaatatttaagcgccacatgagataatatatcctccaattagggcctttagtattgtcattagctcataaccatggtgcatcctcacatggacgctgcataagaagttcataatagcaacagacatatgaacaaagcatggtgcgcctgcccggccggactagctagtactaccaatcatggaataagctagtaccctaaatgaaattaaaatggtttttagcgattatccacgccgtccagaatactctaatccacaagttgaggccgcccatgaagccgcgagagggcgacgccatgtgtataaaaggggcctaagctgagtggacttgctgcatcagattagtaagcaatctcaagcgcagagagccaaagctttcggtgtagctcgaagagcaaagcgaaggcaag

SEQ ID NO: 9 - DNA, 1920 bp, Setaria italica
tgtgccatacccgagtggccattatataaatgtaaacttgattgacgaaataattcaggcacaagctggaaaaatattatttaaattttttttcgatcaatcagggcatcaggtacaaaagctggacagtgtgatcgaaaaggcaacacctggaatggggtgttcgttcggttgggtgagcgcagcaggcccaaaagccgacccaagcaacatccagcgaagaaccagttggacttggaccgaccgattggcgggcgcgcacgtactgatgctgcggggcccactaggcagatcggacggcgggtgcgtcctccgcgtcgcccatcgtgcggtccaggttgtctcagcatctccagctcattccagcctcaggcggctctttggggggcctctatttattttctctctccttttttcgactcgctctcatttttctccatttctttttctttggtcccggaccacaggtacttccagtggaaggaatataattgtagttttctattgtgtaaatagcattgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccacgtctccatgacaaaaaaaaaatactccatgttggactacagtctaaaaaaagaacagagctgtaacatgatgattaaaaaaaagaagaacatttgagacctctgtttcatgctgaaattataccttgtttttttccattcttgttaccgtggtcaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcggggacgagcgcgccgccatccagatccagccgccggaactccgccccctccgccgtcggccccgtcgctccgaccggtcggcttctcccttgctggtaaggaagccctacctttctatggttgttttttttatttcattctgttctgcggtggatggatctcctgttcgctgcgaatgagcgctccaatccgaatccttgttgttgctggtatgggtgctccgattcgtctatctcgtggcggatttattcgctgcgcggcggagtagtagttggatcagtttgtttcccagtttttttgttaggattatgaagaaaggtttatggggaacggaaggtttacgtgccacaataaactgcagcaagcagcctcactggaagtggtagcttgcctgcagaatttatttgataggattacctttcacgggctaaataagcagattctgattagtaggagtacccttcttatgcttgaatctgttgatgcaacagaacaactgaccag

SEQ ID NO: 10 - DNA, 1403 bp, Setaria italica
attgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccacgtctccatgacaaaaaaaaaatactccatgttggactacagtctaaaaaaagaacagagctgtaacatgatgattaaaaaaaagaagaacatttgagacctctgtttcatgctgaaattataccttgtttttttccattcttgttaccgtggtcaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcggggacgagcgcgccgccatccagatccagccgccggaactccgccccctccgccgtcggccccgtcgctccgaccggtcggcttctcccttgctggtaaggaagccctacctttctatggttgttttttttatttcattctgttctgcggtggatggatctcctgttcgctgcgaatgagcgctccaatccgaatccttgttgttgctggtatgggtgctccgattcgtctatctcgtggcggatttattcgctgcgcggcggagtagtagttggatcagtttgtttcccagtttttttgttaggattatgaagaaaggtttatggggaacggaaggtttacgtgccacaataaactgcagcaagcagcctcactggaagtggtagcttgcctgcagaatttatttgataggattacctttcacgggctaaataagcagattctgattagtaggagtacccttcttatgcttgaatctgttgatgcaacagaacaactgaccag

SEQ ID NO: 11 - DNA, 1158 bp, Setaria italica
ttgtttggattcatggatttcaaaatctgattccatggttgtttctttgatacatgccttttttgcccggcgtccagcgccacgtccgtcggaggatgccaccaggggaagctcggggctggctgaagaaatcgagctccagattggtcgctgtggtgttaagactcccgacagaattgccgaggtcccctcgcgaatccatcgatggccagcagccgcgcctgctgattccgctggatccggcgtcggcggccaagcctcgctccgattaggcgagcggcgactatgggcgggcctggtacagtgaacaagcggggcctgctactggggacgagatgctaggaggcggcgcaaggagcgtgcgcgcgatggggagggatgggaaggaggcggtggcggcgggattctgcgagcgacgcaggaggggacggagcacgggaaagatcgaggctttctgtgcgggaacgggaagaaaggggaagaccggagaatggtagaatcggggccttaaacagagcaacacgagaccttcaatcgacgggagatgcggcggcgttcgccggcacaaaggcacggcggagcctgcgctgtccgccgtgcacgctgtggccgagagacggcttgctgtttctttctgttgttgcgggtgatcgaacaagccacctatttcctgtccgatccagccgccggaactccgccccctccgccgtcggccccgtcgctccgaccggtcggcttctcccttgctggtaaggaagccctacctttctatggttgttttttttatttcattctgttctgcggtggatggatctcctgttcgctgcgaatgagcgctccaatccgaatccttgttgttgctggtatgggtgctccgattcgtctatctcgtggcggatttattcgctgcgcggcggagtagtagttggatcagtttgtttcccagtttttttgttaggattatgaagaaaggtttatggggaacggaaggtttacgtgccacaataaactgcagcaagcagcctcactggaagtggtagcttgcctgcagaatttatttgataggattacctttcacgggctaaataagcagattctgattagtaggagtacccttcttatgcttgaatctgttgatgcaacagaacaactgaccag

SEQ ID NO: 12 - DNA, 789 bp, Setaria italica
gggcagcgctaccgctatggagtgcctaggcaccaccgtatcgggggccgctcaagggaggatagagggaggaggatgaagagagagggggaggaagagagggaaggaagacccaccaccacttgttgcctaacatgtggatcaagcgccacatcatgcgaaaccaccctcaaaacagctatgggacaaaaacaaacggtttagaagttgagggatgaccgatatctagttttgcatgtaagggatgaaactcggacaatagcaatagacgtgggaccttgaaaggacttttttccaaaataaaaaagacacaacgcgtaatttgggccaacggtcacaggccgtgggctaacatcctcttcggcctgctgcagcccaccaacatcatataatccgccgcaagcccgcgagctccatcatctacggtctaccgtctacccctgtccggcccacgtatccgcctcttcttcctccaaccgcgacgtccccccgatccaaccctaacccctccgtcctccactcctccgccctccgcatcgccacttcgcacgcaggcgccgaacccccaccgcctccttgccggtgcctcctccccctacctcccctcccggcttgcgactcctcccatcggcggctctccggtgcgtgcccctcatcctcccccttacctgtacacgcctcctcccacttctcgggcgttaatttcaccttccacgctcgctccctctctctctcttcgcttagggcttcgcgttggtcgcgcgggatacgactcctacgtcgcgcgca

SEQ ID NO: 13 - DNA, 1859 bp, Setaria italica
ggtgacgagcatggacagtggcatgcagcatgtggatgggaacgccgtaacaagtgtcgattccggaggccacgggggtgtccgggacctccatctcgggactcgattttcgctaggacctcctctggatgtgacttgtctcttctgtgcaccgatgcacgctgctgcggcgtcggcgattgcaagcatctctcgactgcactgacgggcctctccctcgtatgggtagcctagccatcaactttcctgccctgtttccttcccgcacgcaaggctatgcaacaaaacctttgttagctgccaagctgatggcttttgctcgcttggaggcgacaggtgttgatacctcccatgtgatcgttgcaacagagaacctcgtggagttgtgggagtactagcgtccacccatgcgttaggaacgcagtatccaaccattccaacccccttctggccttctcaactatttgtcaaaattgttaagttaactaaacaatacaaccctgcgttctttttggctcatattgttatttgttcgttccgacctatatagattatgttttatatctctacaatttgctcttgttgtataaactacatgttcaactgatccggttagaatgacatgataatgataatgataataataatgatggtggagggtgcatagtacaaactcccattccataagatggtataatttgttctagatatatagactttttgttctatgtaaataaaattttgctcaacttatattcactttaaaaaatggtagttaaaggatggtggagggtgtagcgttttgttatgtcagcttttgtatgattcgctctctgtgtataatatttttttcacttacataaattttgttctagttaagatggcagtgtgaggagagaagggggcagatgacaacacccggtatattctctctcttcttcctcttcttgagagaggagttctctgtctcgaagaaccttttcatattcttcttttccgcaggctccccggctccatgggccgcagcctgtttgtgtgtgaacggaatagcggcccagagaacgcgcgcggtcgacatggtcgcgaatcgcgatttcgctgccttttttcttttcccgtttttataaataaatcagcccgaaaaaaggacgcggtcgtggaccgaacaaacctttccccaaaatttcccctcccctgcaccgaacgaactctcgatccgatcccgatccctgcagggcgccgcctcggctccccgattcggccccggatctgctcgtcgctcggcgggggctctcgattggtaccagctttccctcctctctttggttccgcagggtcccgaggttagggtttgcgagggtaggtttcgggcctcgattcgctcgattgaggccggattttgcacggggacgtcggatccgtgcgtgatctgtaggtttcggttcggattgtcgcgatttcgagagtcaattttgcgtgatttttctggtgggcggatgcggacctagggtttcgttaggtcccgaagtgtttgactcctattcgcgaattcgatagggtttcaggccgcgatattcgagcctgttgcctgatttaatcgttgcatgagcaaaaactttgttatgttgctaactcagtaggaatggcaattcatttgagcccttcatttcggcagttgaacatggccattgcatttggtctgtagttacctccataaggttgttcgtggggcttgtatagcttatatcctttgttgttactcccgaattggtgttttccttttagtcttgtgcagtgactgtttgctactgagtgacataattataattaatttcgttctgtatcctctcagaacaagc

SEQ ID NO: 14 - DNA, 1943 bp, Setaria italica
aactgctactagcagcacaagcattctttatttttattaacaataatttctacaacatgtcattacaaatattttattcgcgagatgcgagggcacgccaaggcccggagtctcgaggaggacgacatcgtgagatgaatgcatatgtctccttgtgttgcaaggtcacgaatggaagtatacttgctagggctcatcttgttcttcgacgagtggacgaggactcgaggagtccagctgcggactgcttcggcagacggacaccacgaaggacgtaccctccttccaaccactggtctgttttatccaagatctgagatcaagacgaaacataactatggttgcagcttcaattctttgcaaccgctgagtgcaaaacattttatgctgatgtaataatttctatgagaaacgataattacgatgcttatgtgtgagcttgccatatgtgcaattaatgctttattttttaagaaaataatatcttttctatggcaattttatccccacaatattagcccgtagcaatgcacaggcactatccctgtacgtatataaacgactatagctaattgaaatggcggagtatgccttggacccaccttactgctagttgaatcggcgaaattttccttctctaagcagcacatcttaaaaaaatataggaactgtttggctgcacagcactgcagctacagctgctgctgccagcgttttagcctactgtagcggttgcagcaaggctgcatgctagcagcccgaaagtagcacagctaaacaggcccaaaactttttcatatgaattttagatccgaacattgtgtcgattatttgagtatcaagatggttccaaataaaaaaatatgaactacaaagttgtacaatgtttatataaagtttatatttgtctaagttcatatgaaaaagttatatattttttttaaaaaatgtgctgctcagagaaagagaattccaccgattcaactggcggtaaggtcataaattccgttgtttcggttagatagccaattcaaatgtctatatgagtatagatttgcaaacttttattagaacatatatttttacaaaacattaaaaatactttttacaaaacatatagatttgcaaacttttattagctggctgctgcagctgcagccagccgaaagcagcacagccgaacatgcccataactttttcatatgaatcttaatctgaacattgtgttgattatttgaatactaagatagtttcaaataaaaaagtatgaactaccaagttgtacaatatttatataaagtttatctctttttgtgtttgcattcgtatgaaaaagttatatttttttgaaaaaaatgtgctgctcaaagaactggcggtaaggtcataaattccgctgtttcggttggatagccaattcaaatgtctatatgagtacagatttgcaaatttttattagaacatatatttttgcaagacattaaaaataaaagacatataaaaacaaaacataatcaactttccttgaagccacaccactcgccgcagccgcgctctcaaatttcctggagccagaagcgtcggggtccggagccagacgggcggcagacgcggccgggaaggtggggccccacagggataaggtgcgatgggggcgcgtgtgaaccccgtcgcgccacctgacggtgcgccacaggtacggtactgtatattccaacctgccgttcgtctcccatttcccgcgaactcacttgcctcgcgcgctcccgccgcacacaccagaccctccttcctcatcagaggtaagctcactgcagccagagttcatcaaagtctttccttttccttgtccatgaatcctgaattcctgaccatggagctgagctgatgcctcgacatgaatttgtgagcgaaggcaaacacaagcgcgtgcgaggggaagg

SEQ ID NO: 15 - DNA, 2216 bp, Setaria italica
tagcgtagcaggctagcagcctgaactctcgggtgattctgtggcgagttagcttgctcgctgcctgcaatggagtgaatattggcagtacgaagtcacacgggcaggcagagatttggaacatggtggaaacaagaaccatcggcatcgttcttctgatcaatatagtgattactggaagaatcaagaacagaataaaaccaaggcatcctggatctaccatgtcaatctttgctttcatcctcgtcgtttggagcgagcctgttcttgtttgaggcgcgctcgaccgtgccacgaagtaacaggtgcatgaggtctgcagtctgcactagaacttcccagctcccaaattcaacgaaactgaaaaaagtcattggtaacatcaaagtcttgtcttaggatagctgctgttcttgacgctggttagatttgtccaataaattacatgaccagcgcacatgtacttggtattcgacttgatgatttgtatgtactgacggacttgaataaagtagggggaattaggactcagaagtctacgatttttggtccaatatttgattgtgatgttcaaagtcgacgtctctttcgagacgaaattgtgatgcgtagaacaaaaacgacgcaatttcttttcaaaagaaaaagattaggggcagaacaattcaggatctgtttggctggacttataagccggctgaaaagctgaaacggttgatttattgtgagagaaaaacactgtttggtggctgataagctgaaacgaacaggctgtcagtcattaggctgccggctctggaacagtgcgccatcaagagatcacccgaaccatgttgagctcatcaacgtgcgccgctgttgtgctcattggtgtcgcggtcgtggctggcgcgcatctttcgttgcgtcttgtcatggattatccacgacggcagtgtcctgttgtttatgatgacggcacttgattcgccatggatggtgaaaacgaaatcgaagtgcggtcattttttattttaccagatgacgtggttggtgacctgagaggaacagacatgagaagatgagatcagcagctcaattcccacattgacagacgacctttggagcagtacaagagacccaaatgaagaatagtgcaaattacagagtatattagaacacgagaattattaagttttactcgaggtcaatgaaagaatttaggactattcagagcacaggctgtgttcaagtcctgcatgaaccagagaaagttcccaccaaggcctccatcagaggaacgaatttgcctggaactccatcactcaccagtcaccactcaccacttaccagcctaataaagcgtagcagacaatttggagtagacgatcatcatgtgcagtctcataggccctcttctaggaataaccgtatttgatagccaatccacctatgtggtgatttttttttcctttgtccatcggggtcgctttccatccgacgtgtctgcagtgtagcgcaatccatctgtcgctttctgctttctgatgaacgttccggttgacgccgctaagctgccttgtcctccttttctcccgtctgcacagggaggggcacgcccatttcccgtgtgctctggtgcaagccttttcgtttcgcagggcttcttcctcgtgaaagtctctgctcctgcgctcccagggccgcagaactgaagcacggagagagagggcgagcccaggtgaggccccctttctatgccaattctcacacttctgactttttgttcatctcatccttctttgagaattctgtcgaattttggtctatctgtaatgattccagcacacagatagtttatttgagatagcgctgcccttccttctgggtccttgtagtagtagcatcaaaaaaggatattttggagataatcctgaggacgatctttactggatgaaagactgaagcaaaaagctttgagaaactttgttggatgttctgaaaatcttttctttatgagttgatgacacccctgcgttcaaaaccacttgcttaaaaagtggaaaggggcatgatcaaaagatggaaaacaaataccagcatataaaaaagctccagttttgtgaaacaagcatcagggaggataagcatgtgactggccgccgatttacttgcgtagctcacctatttcacagtattcaatttctctgtatttgcccgttgccttgcagtgacac

SEQ ID NO: 16 - DNA, 1479 bp, Setaria italica
actgtttggtggctgataagctgaaacgaacaggctgtcagtcattaggctgccggctctggaacagtgcgccatcaagagatcacccgaaccatgttgagctcatcaacgtgcgccgctgttgtgctcattggtgtcgcggtcgtggctggcgcgcatctttcgttgcgtcttgtcatggattatccacgacggcagtgtcctgttgtttatgatgacggcacttgattcgccatggatggtgaaaacgaaatcgaagtgcggtcattttttattttaccagatgacgtggttggtgacctgagaggaacagacatgagaagatgagatcagcagctcaattcccacattgacagacgacctttggagcagtacaagagacccaaatgaagaatagtgcaaattacagagtatattagaacacgagaattattaagttttactcgaggtcaatgaaagaatttaggactattcagagcacaggctgtgttcaagtcctgcatgaaccagagaaagttcccaccaaggcctccatcagaggaacgaatttgcctggaactccatcactcaccagtcaccactcaccacttaccagcctaataaagcgtagcagacaatttggagtagacgatcatcatgtgcagtctcataggccctcttctaggaataaccgtatttgatagccaatccacctatgtggtgatttttttttcctttgtccatcggggtcgctttccatccgacgtgtctgcagtgtagcgcaatccatctgtcgctttctgctttctgatgaacgttccggttgacgccgctaagctgccttgtcctccttttctcccgtctgcacagggaggggcacgcccatttcccgtgtgctctggtgcaagccttttcgtttcgcagggcttcttcctcgtgaaagtctctgctcctgcgctcccagggccgcagaactgaagcacggagagagagggcgagcccaggtgaggccccctttctatgccaattctcacacttctgactttttgttcatctcatccttctttgagaattctgtcgaattttggtctatctgtaatgattccagcacacagatagtttatttgagatagcgctgcccttccttctgggtccttgtagtagtagcatcaaaaaaggatattttggagataatcctgaggacgatctttactggatgaaagactgaagcaaaaagctttgagaaactttgttggatgttctgaaaatcttttctttatgagttgatgacacccctgcgttcaaaaccacttgcttaaaaagtggaaaggggcatgatcaaaagatggaaaacaaataccagcatataaaaaagctccagttttgtgaaacaagcatcagggaggataagcatgtgactggccgccgatttacttgcgtagctcacctatttcacagtattcaatttctctgtatttgcccgttgccttgcagtgacac

SEQ ID NO: 17 - DNA, 1715 bp, Setaria italica
tagcgtagcaggctagcagcctgaactctcgggtgattctgtggcgagttagcttgctcgctgcctgcaatggagtgaatattggcagtacgaagtcacacgggcaggcagagatttggaacatggtggaaacaagaaccatcggcatcgttcttctgatcaatatagtgattactggaagaatcaagaacagaataaaaccaaggcatcctggatctaccatgtcaatctttgctttcatcctcgtcgtttggagcgagcctgttcttgtttgaggcgcgctcgaccgtgccacgaagtaacaggtgcatgaggtctgcagtctgcactagaacttcccagctcccaaattcaacgaaactgaaaaaagtcattggtaacatcaaagtcttgtcttaggatagctgctgttcttgacgctggttagatttgtccaataaattacatgaccagcgcacatgtacttggtattcgacttgatgatttgtatgtactgacggacttgaataaagtagggggaattaggactcagaagtctacgatttttggtccaatatttgattgtgatgttcaaagtcgacgtctctttcgagacgaaattgtgatgcgtagaacaaaaacgacgcaatttcttttcaaaagaaaaagattaggggcagaacaattcaggatctgtttggctggacttataagccggctgaaaagctgaaacggttgatttattgtgagagaaaaacactgtttggtggctgataagctgaaacgaacaggctgtcagtcattaggctgccggctctggaacagtgcgccatcaagagatcacccgaaccatgttgagctcatcaacgtgcgccgctgttgtgctcattggtgtcgcggtcgtggctggcgcgcatctttcgttgcgtcttgtcatggattatccacgacggcagtgtcctgttgtttatgatgacggcacttgattcgccatggatggtgaaaacgaaatcgaagtgcggtcattttttattttaccagatgacgtggttggtgacctgagaggaacagacatgagaagatgagatcagcagctcaattcccacattgacagacgacctttggagcagtacaagagacccaaatgaagaatagtgcaaattacagagtatattagaacacgagaattattaagttttactcgaggtcaatgaaagaatttaggactattcagagcacaggctgtgttcaagtcctgcatgaaccagagaaagttcccaccaaggcctccatcagaggaacgaatttgcctggaactccatcactcaccagtcaccactcaccacttaccagcctaataaagcgtagcagacaatttggagtagacgatcatcatgtgcagtctcataggccctcttctaggaataaccgtatttgatagccaatccacctatgtggtgatttttttttcctttgtccatcggggtcgctttccatccgacgtgtctgcagtgtagcgcaatccatctgtcgctttctgctttctgatgaacgttccggttgacgccgctaagctgccttgtcctccttttctcccgtctgcacagggaggggcacgcccatttcccgtgtgctctggtgcaagccttttcgtttcgcagggcttcttcctcgtgaaagtctctgctcctgcgctcccagggccgcagaactgaagcacggagagagagggcgag

SEQ ID NO: 18 - DNA, 1085 bp, Setaria italica
agtaacaaatcatacagtatttgccttctataaaggcagctggagactgttctccgaaataaatcatagcaacttaggagtgtttgatacgaggcgctaaacttcagcaggtcatatcggatgttcggatactaattataaaagtcaacacgagctaattacaaaactaattgcacagatggagtctaattcgcaagacgaatctattaaggggctgtttggatacgaggtgctaaactttaacagtgtcacgtcggatgttcggatgctaattaggaggactaaacatgagctaattgtaaaactaattgcagaaccctgtgctaattcgctagacgaatctattaagcctaattaatccatcattagcaaatggttactgtagcaccatattgtcaaatcagggactaattaggtttagtagattcgtctcgcgaattatactccatctgtgcaattacttttttaattagtctatgtttaatactcctaattagtatccaaacatccgatgtgacaggtgttaaactttaacagggcgttcccaaacacccccctaaagctaattaatccatcgttaacaaatagttattgtagcacaacattgtcaaatcatggactaattaggcttaatagattcatctcgcgaattagactccatctgtacaattaattttataattagactatatttaatacctccaattagtatcaaatattcgatgtgacatgtgctaaagtttagtagggtatccaaacaccccttctctcctttcctcttggtatgtttagcagttacccctggctcttggcatccgtttcgtcgacgtgccatggtttaacggacgggacggggacggccggctcacgtgaacaacgcccacgaggccgcgctggctcttgtaaaagcaaccgctccctccctagacgctagtgcctctttcctctctcctccgcccctttttatcgcccgatctcacacattttggaaagaggagagagagaacgcccagccaaacagccaaggaaacaaaccgcggcgagaggcggaggagagggaggaaggagggcagaggacgagcaag

SEQ ID NO: 19 - DNA, 1573 bp, Setaria italica
ttcaatttcactggagatcgttccaccagagaaatcaccgtcggagtaattttaggatgaaaggcccaaaagcctaaatggcaggcctaccccagaggcccaagcgatcaagggtagctccgtactttcccgcgacggtgcgatacacggttcgaaatttcaaaattcgaacgggcggccaaacagccgttccttccatttccctgccgtcctcacaaaggctccccttccatccaccgaagtgaaaactaccccgactcaatgactcatgggctgggcagttcactttcatattccagtcccacatgtcagtgtcacgtcttcacgggcgcatgtgaagatcgccgagaacgagaggcgccggctccgcgggacccgccgccagctcaaacccaccgttgccggccgctgatcacgcaagcctcgccccgacgttcgaaaccaaacggccgttaacctccgctgcccccgcgcggcttcggccccgttcaccaacgaggcgggccaccaccacgccgtctaacgcgagccaaacggcggttaggtcacggcctcaccctcacgggccggccgcggccgcctcccctctcctctcgcgctgcctataaaagccgccgcggccgcctcccctctcctcacctcggcgtcttcacaaacgccagcgctccccttccactcccgatcgatcgccgctccgctccctcttccctcgcctccgcctccgatcgcttcgagaggttcgtcgcttgacccgaagggttcgcccccggttgcttgaggcgagtcggggaggaagttccaggtccagtcgccgcccccctctcctcccgtccatcatctcgtcgtcctcgtcgtttaatttccgatttgattcagaggagtcctgcgatttgcagttgcagggcgttagaattctgatttggggtgaactgttttgggggaatttagtcagatctgttggtgctagtaattttagggttcgaaatttgctgcgcgattcaaactgtgattgaggctggaagtaagtagttgctgtcggttttgttgtgcggtacctttgcagcggaagtaagtagttgctcccatcgaatcgaatttttataatttgcagttgtgggtcacgcgttacgcctgctctcgtcaaattgtgcagtgttatttaaatgcttctgtgctctattcgtagtcatcagttttgatcggtttgtgtgtaattgtggatgaattgcgctatttctaaagtttcagttatagtgtactagaagttgattagattagaaaaacgaatatgccttctatcaattcggtggatcccgttcagattctttaaattaagtcatgttcgtaccatttcttagatctgaatgcaaattggactagaggttgtgttcggtgcatgtatctctgagcaactgatatatcgcttattgatgcactgcataatggctaattaaattgatgcatatcataagttgctccacttattgataacatgttgaacccgtgcaattgctcctttgaaccctttataatttgcatcccattaaactgcttttttcccttgcagcctgat

SEQ ID NO: 20 - DNA, 2622 bp, Setaria italica
actgccgcgacacgcctcactggcgggagggctccgagcgctctctccccggcggccggcggagcagcgatctggattggagagaatagaggaaagagagggaaaaggagagagatagcgcaaagagctgaaaagataaggttgtgcgggctgtggtgattagaggaccactaatccctccatctcctaatgacgcggtgcccaagaccagtgccgcggcacaccagcgtctaagtgaacttccgctaaccttccggtcattgcgcctgaaagatgtcatgtggcgaggcccccctctcagtagattgccaactgcctaccgtgccactcttccatgcatgattgctcccgtctatcccgtttctcacaacagatagacaacagtaagcatcactaaagcaagcatgtgtagaaccttaaaaaaaggcttatactaccagtatactatcaaccagcatgccgtttttgaagtatccaggattagaagcttctactgcgcttttatattatagctgtggacctgtggtaacctttctcttttggcgcttgcttaatctcggccgtgctggtccatgcttaggcactaggcagagatagagccgggggtgaatggggctaaagctcagctgctcgaggggccgtgggctggtttccactagcctacagctgtgccacgtgcggccgcgcaagccgaagcaagcacgctgagccgttggacagcttgtcataatgccattacgtggattacacgtaactggccctgtaactactcgttcggccatcatcaaacgacgacgtccgctaggcgacgacacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggaatggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcccgttgccgcaagactcagatcagattccgatccccagttcttccccaatcaccttgtggtctctcgtgtcgcggttcccagggacgcctccggctcgtcgctcgacagcgatctccgccccagcaaggtatagattcagttccttgctccgatcccaatctggttgagatgttgctccgatgcgacttgattatgtcatatatctgcggtttgcaccgatctgaagcctagggtttctcgagcgacccagttatttgcaatttgcgatttgctcgtttgttgcgcagcgtagtttatgtttggagtaatcgaggatttgtatgcggcgtcggcgctacctgcttaatcacgccatgtgacgcggttacttgcagaggctgggttctgttatgtcgtgatctaagaatctagattaggctcagtcgttcttgctgtcgactagtttgttttgatatccatgtagtacaagttacttaaaatttaggtccaatatattttgcatgcttttggcctgttattcttgccaacaagttgtcctggtaaaaagtagatgtgaaagtcacgtattgggacaaattgatggtttagtgctatagttctatagttctgtgatacatctatctgattttttttggtctattggtgcctaacttatctgaaaatcatggaacatgaggctagtttgatcatggtttagttcattgtgattaataatgtatgatttagtagctattttggtgatcgtgtcattttatttgtgaatggaatcattgtatgtaaatgaagctagttcaggggttacgatgtagctggctttgtattctaaaggctgctattattcatccatcgatttcacctatatgtaatccagagcttttgatgtgaaatttgtctgatccttcactaggaaggacagaacattgttaatattttggcacatctgtcttattctcatcctttgtttgaacatgttagcctgttcaaacagatactgttgtaatgtcctagttatataggtacatatgtgttctctattgagtttatggacttttgtgtgtgaagttatatttcattttgctcaaaactcatgtttgcaagctttctgacattattctattgttctgaaacag

SEQ ID NO: 21 - DNA, 1810 bp, Setaria italica
cacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggaatggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcccgttgccgcaagactcagatcagattccgatccccagttcttccccaatcaccttgtggtctctcgtgtcgcggttcccagggacgcctccggctcgtcgctcgacagcgatctccgccccagcaaggtatagattcagttccttgctccgatcccaatctggttgagatgttgctccgatgcgacttgattatgtcatatatctgcggtttgcaccgatctgaagcctagggtttctcgagcgacccagttatttgcaatttgcgatttgctcgtttgttgcgcagcgtagtttatgtttggagtaatcgaggatttgtatgcggcgtcggcgctacctgcttaatcacgccatgtgacgcggttacttgcagaggctgggttctgttatgtcgtgatctaagaatctagattaggctcagtcgttcttgctgtcgactagtttgttttgatatccatgtagtacaagttacttaaaatttaggtccaatatattttgcatgcttttggcctgttattcttgccaacaagttgtcctggtaaaaagtagatgtgaaagtcacgtattgggacaaattgatggtttagtgctatagttctatagttctgtgatacatctatctgattttttttggtctattggtgcctaacttatctgaaaatcatggaacatgaggctagtttgatcatggtttagttcattgtgattaataatgtatgatttagtagctattttggtgatcgtgtcattttatttgtgaatggaatcattgtatgtaaatgaagctagttcaggggttacgatgtagctggctttgtattctaaaggctgctattattcatccatcgatttcacctatatgtaatccagagcttttgatgtgaaatttgtctgatccttcactaggaaggacagaacattgttaatattttggcacatctgtcttattctcatcctttgtttgaacatgttagcctgttcaaacagatactgttgtaatgtcctagttatataggtacatatgtgttctctattgagtttatggacttttgtgtgtgaagttatatttcattttgctcaaaactcatgtttgcaagctttctgacattattctattgttctgaaacag

SEQ ID NO: 22 - DNA, 1964 bp, Setaria italica
  misc_feature (559)..(559): m=a or c.
  misc_feature (1056)..(1056): y=t or c.
cgggcgggtctgtgccacgtgcggccgcgcaagccgaagcaagcacgctgagccgttggacagcttgtcataatgccattacgtggattacacgtaactggccctgtaactactcgttcggccatcatcaaacgacgacgtccgctaggcgacgacacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggamtggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcccgatgccgcaagactcagatcagattccgatccccagttcttccccaatcaccttgtggtctctcgtgtcgcggttcccagggacgcctccggctcgtcgctcgacagcgatctccgccccagcaaggtatagattcagttccttgctccgatcccaatctggttgagatgttgctccgatgcgacttgattatgtcatatatctgcggtttgcaccgatytgaagcctagggtttctcgagcgacccagttatttgcaatttgcgatttgctcgtttgttgcgcagcgtagtttatgtttggagtaatcgaggatttgtatgcggcgtcggcgctacctgcttaatcacgccatgtgacgcggttacttgcagaggctgggttctgttatgtcgtgatctaagaatctagattaggctcagtcgttcttgctgtcgactagtttgttttgatatccatgtagtacaagttacttaaaatttaggtccaatatattttgcatgcttttggcctgttattcttgccaacaagttgtcctggtaaaaagtagatgtgaaagtcacgtattgggacaaattgatggtttagtgctatagttctatagttctgtgatacatctatctgattttttttggtctattggtgcctaacttatctgaaaatcatggaacatgaggctagtttgatcatggtttagttcattgtgattaataatgtatgatttagtagctattttggtgatcgtgtcattttatttgtgaatggaatcattgtatgtaaatgaagctagttcaggggttacgatgtagctggctttgtattctaaaggctgctattattcatccatcgatttcacctatatgtaatccagagcttttgatgtgaaatttgtctgatccttcactaggaaggacagaacattgttaatattttggcacatctgtcttattctcatcctttgtttgaacatgttagcctgttcaaacagatactgttgtaatgtcctagttatataggtacatatgtgttctctattgagtttatggacttttgtgtgtgaagttatatttcattttgctcaaaactcatgtttgcaagctttctgacattattctattgttctgaaaag

SEQ ID NO: 23 - DNA, 369 bp, Setaria italica
caattcactctgaaaccaatttccaggcatgggcctcatctattgctagctccaccgactgctaaagtggactagcttccaaactactccatctttcttctgcaaaagtatgtcaaacagcgtatacatcatggaacatattggtaaattaaacttcaccagttccgatcatgcatgcagctgcaggttcccagcctgttgcctgttggcaccttttctgctctaataattttggaatggaaccaacccctatgatatttcttctccatctatatatttcggggttagcttgcatgctatccgacagagactaagttgagtgtatttccttgaccgttcagattgggagtggtcgtttccacgatagat

SEQ ID NO: 24 - DNA, 1419 bp, Setaria italica
tgtgccatacccgagtggccattatataaatgtaaacttgattgacgaaataattcaggcacaagctggaaaaatattatttaaattttttttcgatcaatcagggcatcaggtacaaaagctggacagtgtgatcgaaaaggcaacacctggaatggggtgttcgttcggttgggtgagcgcagcaggcccaaaagccgacccaagcaacatccagcgaagaaccagttggacttggaccgaccgattggcgggcgcgcacgtactgatgctgcggggcccactaggcagatcggacggcgggtgcgtcctccgcgtcgcccatcgtgcggtccaggttgtctcagcatctccagctcattccagcctcaggcggctctttggggggcctctatttattttctctctccttttttcgactcgctctcatttttctccatttctttttctttggtcccggaccacaggtacttccagtggaaggaatataattgtagttttctattgtgtaaatagcattgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccacgtctccatgacaaaaaaaaaatactccatgttggactacagtctaaaaaaagaacagagctgtaacatgatgattaaaaaaaagaagaacatttgagacctctgtttcatgctgaaattataccttgtttttttccattcttgttaccgtggtcaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcgggg

SEQ ID NO: 25 - DNA, 902 bp, Setaria italica
attgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccacgtctccatgacaaaaaaaaaatactccatgttggactacagtctaaaaaaagaacagagctgtaacatgatgattaaaaaaaagaagaacatttgagacctctgtttcatgctgaaattataccttgtttttttccattcttgttaccgtggtcaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcgggg

SEQ ID NO: 26 - DNA, 676 bp, Setaria italica
ttgtttggattcatggatttcaaaatctgattccatggttgtttctttgatacatgccttttttgcccggcgtccagcgccacgtccgtcggaggatgccaccaggggaagctcggggctggctgaagaaatcgagctccagattggtcgctgtggtgttaagactcccgacagaattgccgaggtcccctcgcgaatccatcgatggccagcagccgcgcctgctgattccgctggatccggcgtcggcggccaagcctcgctccgattaggcgagcggcgactatgggcgggcctggtacagtgaacaagcggggcctgctactggggacgagatgctaggaggcggcgcaaggagcgtgcgcgcgatggggagggatgggaaggaggcggtggcggcgggattctgcgagcgacgcaggaggggacggagcacgggaaagatcgaggctttctgtgcgggaacgggaagaaaggggaagaccggagaatggtagaatcggggccttaaacagagcaacacgagaccttcaatcgacgggagatgcggcggcgttcgccggcacaaaggcacggcggagcctgcgctgtccgccgtgcacgctgtggccgagagacggcttgctgtttctttctgttgttgcgggtgatcgaacaagccacctatttcctgtcc

SEQ ID NO: 27 - DNA, 2348 bp, Setaria italica
gctgacactaactttatcgcttggaagacaagcctcagagcataacccttaatttcagtatccagtggttatttatccgtattgtgcattaagtttctaggtgttgattcaaaccttagatgcatgatccctaggtttccttgttgatctactagtatgtgtaggtcattagtactaccatgcttaattaggttttggtagaagtctagtgattttctatcactcgcgagatacaagatcttttgatacttttaacaaaggttacttgagaatgaatcactgaggaaagaaaattagagaccgggcggagatgagtttggttaaggatatgaagtggattgaaagtaaacctctgcctatgttcattaaggcccgaaccgttgttggctgtgctgatcggggattgaacagtactaacgacatgccgggagtaggaggtagtcgaaaccagcaaaccttcgtaccttggtgcgcgctaacaacttgagcttgatcctgacttcagcatcgggtactattctataactcatggctgaccctacggggtatcgacggggactagtgcttgagggtcatggggcaattcaaatgttagcgttcgccaagagaatggttgccatgcgcagctcgacggggcattgcgtgtgttgtgtgattagatttaccttgcaagggataaaatcggatcaattcaccatatctctcggataagagaactttgatcacttggtcacgtgtagtaatggaaatggaatggtgatgacatgagatatgtttatgatattctttgatgattagtgttgtataacatgctagctctggttagttatgcaaacctagttggtacttgctacatattaaacccaagctaaaatattgaaagtaaggatctagtaagcttctttttgcaaaagaaacccaaaaaactagaactgagtcatctaagtatttaccacagtcgagtaaaacttgttgagtattagtatactcagagttgttgttgtgatcctgtttcatgtggtattacattcatgtcatgacacatcggtaggctcattgtgttgtcctctgctcgttgtcgttgatagtttatcttctagcttagctttggcaatggttttcaagtttctttccgctgtgcattttaaagctctgtattatttttatatttgaactctatttgtaaagctaattgttataccttaatttgtatagtgtttgtattatctctgctcaccttcgtgtgtgacttgtggtgtattgtttcgatcgagatatcagtggttgaatcaggcttgaccagacagactgttagattacactgttttaagtgtgtactgaccgaatcaaccattaagaggatggttagcgcactggtttaatctgggctattctaccacagtatgaaactggttaatgattttgtctacgtagattcatccccgtctatctatttgggttataccatcgacatacatgcgcgtgcttgttcaaccccaatagcacaatcaatctatatatgctgaagaaaaggagttcatgggcttgtcggctttcgcttcttaatacatggcacaaatgtcgtaaaaggcccttagctcagagaagggtagtgtattggcccacattatgttcatcattgggccatgaatcgtacgattcacttggctcccccgctccttattcgaaaaagaattgattttgatgcactagtaaggtgattatcattttgatgaaatgattccattgggactccaactaatgcgtactgaccgcagctaatactttgtatgccaatgacatgcaacatgtaacaagtacgttgcttaatttgttattggactccaactaatgcgtactgaccgcagctacatgttggatcaggccatcatctccaatgccaacgcggactccttgaagttaaaaggctatatcgttggattcttcagaaactactcaaggaatgggattgatgtcgaaagattttatagtatataagaattactagtcataggtctaaaaaaattctttttattgtccatctaagcccacttaaaattgtttttgtaaaagtatatgaaagatgcatattcccgggagaatcatcaaagaatagtggcttcatcctctgggttttcttttgttcatccatgattcatagattatttttattgtcctatgaacttgtataccaactacttcgacctcaaccagcaggtcctgtactcattagtcatcgccactgacctctagccgccggatgacctataccctgacgcatcattggcctatcaactgcaatataaattgaggcaccaataagcccacttcactcaacactcaaacta

SEQ ID NO: 28 - DNA, 1577 bp, Setaria italica
caatcattgccactgaaatccctgagtataacatagttctcacgaagaaggccaaagttgagcccaaaatttttcgataaagtcgttacatcttatttcgtacttatatcatctttacacacatgatcaatatttttttctagcaaaaagtcatgcatgcttccatatacagtgaagatatgggcatggataaatcctaggaacgcaaaaaaaaaattgaccttgctatggcccacgacttcttgattctaccaatttgacgcatgaaacctctctcaagaatggacataaatttttggcaaaaaaggttcaacccaagtatataacataacacacgtatcacaatagtctacgttgctagcatgatggggaacaatacatgctcataaaccaaacatcattgtttaaaattttttggttacatgtttgattcacatgttgccgtaaaatggtgctgatgagcttagacgaaggactcattgcgcttcctgttatcttgtgcaaacatctcaaaagtcattattcaaattcataaagtgaacgatacaacacttttaaccggcgtaatagtttaatagaggtagcgtatagggtcggaatatcatcttctttgtagccataggcatgtcgcacccaagaattgaatggaaatatgataccgttaagttgagcgccagtgtctcatgttgttgtgcaccgatgaaattggttcctgagtatatatggaaaacaaaagagtctaggttttaatccgatccattgttaccacacatccagaaacactatcttcaacttttcatagaaatattatgcaaaagcaggaagaaaaacttcctatggatcgatatagatggccctacaatatgtatctgtagacaaggtagaatacattcaaatatgtcaaaagtagaatcttgggaaactacaatgtgcacaagcagcggtcctcccactttgagcgactttcacctttagagagatagctctaacatatgcatgcgtagatctggtgcaatatatccacaccgattgcaaacggattccacgcaaccacaacgcaaacaccttgtttgcgtgacttacaatactgacttaatctaggttcttgtgtattggctcattacttacttgataacttcttctagaactagtgcgttacctctatcatccatgaggattggctcatggaacaaatcctatccgagtcagatgaacaatgaagctcaaaatgatttggatccacatcagcaaatcacagctttacaaaccaactttaacaaagtggaacacatatttttgtggctaagactttcacgtgtttaaaggtgaaccgaccatgatgttgtcacaaagacaataccaacagaagaagacacttttttgcttgtacaacggcaagttgtcttgccaacacatacattacaacacaagggtatttatcactaaatgccaaaattgactagataccatgtcatctccagtttatcaagctagcgatttgcaaggcacaagcaaaaatcttgctaaagctacatgagctctcatgcctataaatacgccccaaatgttgtgtaggt

SEQ ID NO: 29 - DNA, 412 bp, Setaria italica
catccatgaggattggctcatggaacaaatcctatccgagtcagatgaacaatgaagctcaaaatgatttggatccacatcagcaaatcacagctttacaaaccaactttaacaaagtggaacacatatttttgtggctaagactttcacgtgtttaaaggtgaaccgaccatgatgttgtcacaaagacaataccaacagaagaagacacttttttgcttgtacaacggcaagttgtcttgccaacacatacattacaacacaagggtatttatcactaaatgccaaaattgactagataccatgtcatctccagtttatcaagctagcgatttgcaaggcacaagcaaaaatcttgctaaagctacatgagctctcatgcctataaatacgccccaaatgttgtgtaggt

SEQ ID NO: 30 - DNA, 1631 bp, Setaria italica
actgcgcgtggcacgaaggttatcaaattaaagcctagcattgcacaatcgccaaggatcgcaaaacaatcctcctcctcatctgaggagctgtagctgtcctcatcgtcgtcctcctcatccgatgagtagtcactgtcgtggtcatcttcctcctcatctgacgagcagtcgctgccatcatcgttgtcatcttcctcttcgtctgatgatgagtagtcactgtcgtcaccatcatcttcctcatccgaagagcagtcgctgatgtcgttgtcgtcataatcttcctcctcatccgacgtgtagtcgtcgctgccatcgtcatcggacgaagacgaagactcagtctccggctcgagtatcccttcgagtttcttcagtacccgttcaatggctgcctgtaagcctgccttctgcctgacccaatcgtcgtctacctcgacatagccctccttggcctccatctctttgcgcacgcacttctgcaacttctgatagccctcctccgtctgacagaacgcgttggccctgaattagaagaggtcaggtagccgtcggcgtcaggccggggttgctcgtctctgctaatattgcagtgcatctaggcaggagtccgaattgaactcagagtcctcgatcgatccggattggcgttaaagcacggattagggtaggtttgcaggttatgtggtctgcagatttcttcctttcagagtttgttacggacttctgagtgcaatatatggccgtgctggggtacggtgttgggtcggatcggactgtgggctgaaattgggagcaggtcgaaccgaaaaaaaatagagaagaaaaggattttgtgggctatagatggctagtgagtagtgactgattcttatgtccttcgaaacttggaggggctcatatacatgttgtggtaaaactagcaaaaaacaaaatggagagagagcgagcgagcgagatgacacaaattgaacaatgcagagtctactcaatgttcttcctcctttgggtcggatttctatgaagcaatgttcatgttttttcacgcgacccggatcctatatttcctttttctcttttttcctaggaattggtgggatttgcccaacttgatcatctcacaatattgacctagaatgtctcttgcagtgtaatgctcatcattggtgcaaagcattctagcaggtgagaaaacatgaacgactcaatgacatccatgaggattggctcatggaacaaatcctatccgagtcagatgaacaatgaagctcaaaatgatttggatccacatcagcaaatcacagctttacaaaccaactttaacaaagtggaacacatatttttgtggctaagactttcacgtgtttaaaggtgaaccgaccatgatgttgtcacaaagacaataccaacagaagaagacacttttttgcttgtacaacggcaagttgtcttgccaacacatacattacaacacaagggtatttatcactaaatgccaaaattgactagataccatgtcatctccagtttatcaagctagcgatttgcaaggcacaagcaaaaatcttgctaaagctacatgagctctcatgcctataaatacgccccaaatgttgtgtaggtattcc

SEQ ID NO: 31 - DNA, 1719 bp, Setaria italica
ggaacaagggagataacttcaaacatgtcatcttttccttctttttttagcaagaacagtaggggaaaccctactgcggtaaagaaagttgtccaaaagggagaggaaaaaattaacgaagggcattaaggcatgctaaggaaaaataaacttctagtagatagttcctttactgagcctgaagtaaaatgtcattggtaaatcctttctgccaagaagagaagctcggtctattgcttttgctactaatacagcttgcattgtactaattaattaaccttgtgatctgtctcccttatcatgatcaccacgtgcacatagtgattagtccatgcccgaatttgtcaaagtcgttacgaaaatctcgaggtcgcctctgcaatgtcaaccactgcaagaggaataagaattgtttgggtgctcagcgtatgcctgtgctgatcttcaaacaagcagttcagacttaatgcaggttgttatttactagcttcactgttagtataatgctagtatctgacaacaaaagataaaccctgggtttaattactatgggcgatctcgttatcttttgattgttgtctcaccagctgtacatgtttcacagtgctggagagaatggtcaaatgcatacagtgtaaggaatgaaatggcatgagcatgcatatttaagcgtattgtcatatgcataaattttgcaggtttttcaaccaaacaatttattccaagagaaagccaagacaaaatctcatgttccaaagggagcacaaaatccttgcgaaagtaagacacttgcttttgttctcaggtcgggtaaaatagagtatgtgttaagagtttggaagtttctagtatatactttacagatctgtatggtctatctttggagctctgctggcgccaagcacttgtgtctgcttggatggccaatggcaggaagcctgctacacgtttagtctctctggtctctcctccttcctatctggttgttgttgtttcttactaggaacaatcttgtgagcctttgatccgtatacgtgcgcccggttggcccgcgttgtaactaaacgttcttcgttatatcttcttaatacaaagatacgcagctctcctgcgtattctcgaaaaaaaataaagatctgtatggtccttatccaagaaccctataaatgcacagatcaaggagagacacaacatgtaagtaaatttcaagcgatagtttatggaacgggacctagcttcacctattagacaaatcagtctggtgccaaaatcttttgctgatttagtagcagtgacaagtacaaaaaactgaaaaaacttgataaataacttcactattaacacttagaatggagcaagcagctaggtttagtttgaatgggtcttccaaacaccaatgaccatgtcaaatgctaaaactttgtgccatcaataatatatggagatgactttaagaagctagcacttaggagatcatctagagaggagagcatagcgagtactagtgagaagaaaattcgtaaattgtggccacttctcttcttgcatgtactcaatggtcaagtcaagaagctccattaattccattggctttaaaagcctccacttggtctcctatgggaacacactgccgttaacttgcatgatattaagataaagaaccactacgtggcctccagcactataaatacccatgcagccttcacttggaactcatca

SEQ ID NO: 32 - DNA, 2079 bp, Setaria italica
aaactttaaagcgaaaacaaaaatatatcacaagtcaagcaatctcacttttaaggtaactgaactctactgtctgtgaacaacttataacataatttattagcacacaatttcatacagaaaaatatggtgatataccaccaaatgataccataacgctgaaactttttaaggtagccaccactaacctcaaaatcccagaacaatccacgctcactcatctttagctctctattttctccacagccgcttggccattccctgccctgcatgttttccaaagctgcttgtccaatgtccacagtagagaaaataggaatggcttgccttcagtgctaggccaaaccttgaaaactcaggtgcaaccgctgccttggagtatctacgtattctgaggtctcaacttcaaatgccttgtgtgaccagacagggcacttgttgttctataggttgcaacaagttgcccaccatggtgctactgattgaacaactggcttatttcaggcacactaaccttggtttaagttgtgatgttggggcagaacggttgtcaaatccaacagtagagagtggaggacaaagataggttaagaaagatgatggagaagggttttctcacatcttttcttattagtgggtgggtcttgggtgtgggtggataaaattggacaacctatttttagtggtattttctgaactatctgtgtgcagatctgccctataatggatatttcattataattctactgataatttatcattatccatatttgctcttacattaatgtttggcagtttgaccgcatcttttctgaaattaaaggtcctgcctaacatcatttgaatcgcctaagtactacagcctagtcgatgaattgaccagttattagaaggctagtgcaaattcttcgaaatcctgttccatcagatgttaacagaaatgtaccgagatatttgaagtagcggtaaaggtataattctgtgagagtgacaacaagtgcttgcacataaataacataaataggaacttcctctaatctacgttcaaattttatgttattactatcagtattttatttcacggtgagaacgaaaacttcaattcttctattagaggacatactattgtctgataccataaattacattggatttgtttggtctcccagcctattgtttcttttgcacctcacattgttttcagtatcccaatttggctagtaaaagaacatgactattgtaatgcagtgtttattgttttcatcatttcttcctcctctattccagggacactgttgttgctttattcgacgagctggttatcaacaccaagaagcttgtgacggcaacttcaaaagggatcgaaaaatggcgttgagctgcaccaccgcgtcattgtcgatattagctgccttcaactgcggtgtatcaagtgaagattagaagcagtgtttatcttgaacaagcagtggcacttagatctagaatccagactgtcgcatcgtatggctttctcttgctcatcagttagtagctttgtatctaagtaggatcctgaaatgaggccgacgatatctggtagatatatttagttacatgccattgtgttgagtgatgtccctggtgctgggttgctcatcacagatattaaattttagaatgaattgatgtgtgagattcagatgaactatgatttgtgcttgtgcgcgtgttcttcaccctcttggtaccagtgtgtggcctggaattgctgtcttggttctttctctatcactggttggttctccctccgtctccatctatcatgtttgttagtccctatactactgacaaaaaagttcaccagaggccctaatgctgccacatcagcgccctctaaagttgccatatcagcatcctcatctgccaagtcggcacagcctgcccaatcgcatccaagcaacagatagccctcctgggcacccagccaatggcagctcccatggccaaatctcagatgggcccacagcatcctccgatccccatttccatccatttaaactagctcaccttttcctccacaaacgcccatcagccatc

SEQ ID NO: 33 - DNA, 1365 bp, Setaria italica
attatggccaattatttatcggcctggtcctggcaggatgagtgtagtagtgtacctaatttggtaggcaatgggtttgagttaggccaataaatgtgcaggtttacatttggttgccatgttagttcataacttcatacacttccatttttgtacgtcggcgatgtttcaaccagaacagattatgtttccttgggactgtaaatttcttcatcgctccatcccaatgaacttgcaagagattcgtgttagcaaccaaaattgctctgtccttcccaaaaagcattgcctctggatcttttccgatcaagatcagaaaccctatatgtattgttcttatgttctgctgtgggtcgttggttcttgtcacccttaaacttctctgtttggtacccagataaatacaaattcggctggtgggtagaaaaaccgcctacgaacactggtttcaccttataagactactgcactgtttctagcaggcttatttttctcttcgttttttatattccaatgtatacatattaatgtttatcgagctatgatcttataaatttgtacatgcttcaatattttctaaaaacttgaataacagtatgtaaaacctaggttgatgtttcaaatgaacttatttaacattttacgttgaaacagtacatcgcgaatggcatattattttgttgcatttattctaaacaccttaaaatggaatttgaaaacgggctctaagtttgagagaagtttaagggtaatagtattctaaacacttcaagtttgagatccaaaataattaatctctcacctatcacctccaatcaagttgtttatcagtttatgccatgtacatgtatcgctggtttgttatttcacctcattttcgctatgtatctactactattgcgctaatctcaaatattagatgacatgtaaactaaaatctttggaaagattaataggatacccgcgggtgctgatatctgtttctaaaaatgttgaatctaactatttgtaaatattgatatatttttcagaaatgttggatttagtcttgtgaaatgttgaaccgatatctctgatatggatttaatgggcttaaagcttccactagccgtgtgcatgggcgaaaaaaaatcttggccaagtgttactccgtcgcggccacacgccacaagtcctcccggccctcgctcgccccttatcccatcgtacccgccacacggcgcgccaccagtggcgccgcggatgcgcctcatctccccggcggccacctcgcgcggtttagatttccctgggcccccctcgcggtaccgtcacatatttttggcgcctcttcttctgcgcccctctcctcccgaaccgcagata

SEQ ID NO: 34 - DNA, 603 bp, Setaria italica
gagtagggcaggtggcgctggagattggagggcaaaccgggaagcgcgggatggagggaggcgaagcggacgacgtgggggaggctcgcggacgctgaatcgatcggagggtaaactaggaagtgcaggctggagggaggcgaagctgacggtggggggtggttcgcggacgcggaaccgagtggaggaacccagacctaggaagttttttttcaccttttttggttttttcgagtccagatagtaagtatgttgttgtatacttttctcatccaagcaacccctttcaggatccaaattaaagaacttgagctatgtccccgccatatgatcttctctgtcccttttctttaggaatataaaaacatactcgctaatcatgagattatactttaatcacgacattatacttttctttaggaatataaaaacatagtcgctaatcacgagattatactttaatcctatatatggtccccgccacatgatcttatctgtcccttctctttaggaatataaaaacattggtagccaccagcatcagagctgctctctgtatttaattactatatcgtagccaccagcagagctgctcaatccgca

SEQ ID NO: 35 - DNA, 1013 bp, Setaria italica
cgtttaatcatattttcttcgttccgttccgacaccaaaagcgagagttgatgatagctgggcgatgcttgtgccttgtgcgtttggctgggcctggtgcgccggcgtgcagatcggaggagggcgttgcgtgcccgcggcacgtatgcaacagcaacgcaaatggagccccgacagcgccgtgtatgcttgcacccaacgtctcgacgaccacgcggcacggcacgcaaaaaatctggccccggcctctgtcgcacagatctgtccaacatctcctgttcgtatgatccccctcgtgaatgcgatgcttgctaacactaaataaggtttcccctttttcctttttgcggggaaaagaattgaatgtttccctttgaaccgtgcacgccgcactgatccagccctgctcaccgggactaaaatatcgtcgccggctgactttacactacacccacccacccgtcgaccatcgccatcgacgaggtaaacagcaaagcaaaagataatcccggcctccaaacgcgtcatcggccacttgggcttgggccactcgcagggaaaaatcgtgccgaatccacatcgaccctcctatttgctattcctaccgtgcccgcgccttcgctgaacgtctcctaccccctgcgcttcttggaacgaccgcaccaacaccagagcaagggcgcagccactggccacttgttacgcaaaagaatcctatccacgacaggcggatcggggagtgggtaggtcgcggcaggtggcggtggcggtggtaggaatgaaccccgggatcgtgcgtttgtggactgccacaacgacgggtgctcgatccatgtgttctcctcaatcaaaaaagaataaaaaaaacgttaatagaatggaaaaggtgaatgcttgaggaggtttggtgggtcaacagcaacatgagagggaaatgtctttggtttccaggaaggagagagttggtgagagcgccggagtgtaaagtctaaggcactcgcctttgctttata

SEQ ID NO: 36 - DNA, 973 bp, Setaria italica
atcttcgagccgttgccgtcaggaagcttgcatgaggggcggcaataaggtttctgggcagcgcttgccttcatcaacgatctgcaatgcaccatgtaaccctgcatccgagtctacacgagggctgagtgcttgatatgtaagtccatagattggatctgttgtggtttgccatcatgtgcaggaaggttacgatgcttagaagttttggttacatatgccttctatgtgttgtttttatacaccgtttatatgagtttgttacggtcaaactgtctgcaactagaattgagttacatagaaagtagcactgagttacgtaatatgcctcatgtttatttctggtagaattaaatgcatatttccaacatatatttccatagaaatattgataaaggtagatgtgggactaaggccgtgctgtgcctctcgtgcctcgtgctacttcgtgcctagattttaagttacaaggcattatacgtgccgtgcggtgcctgcactgtccaaaatttatcttgccattccgtgctttgggttgtgcaaaatatcacgcttcgggtgattcataaatagcacagcccaaattccaattttaaatgaaagtagcgcatcgtatagactcctgttcgacatcgagactatatactgataattagtaattcgttctcactttaatatgaaaactttagacgattaacctctgcacctattccttcctcaaaagttgacattacgtgccaagctgtacgctccaatttggctgattaaacatcaacacagagtactggactggacacaaccaatatactaagcttgatagtgccacttgaacttcatcacggtatcctataatcatatacaatggcatcgtcgatgtcctccaaagtcaatacacagttatctccaggctccagctgcatggcagcccattaaaagcaccaattggccccggcaaactctcaccaactttgca

SEQ ID NO: 37 - DNA, 1101 bp, Setaria italica
ggggcgagacgctggcacgacgccttccttctattcctagctcagcagtaagattccattcctcactcctcggattccccaatccaagggttcaaattccattcgtgcttggtttgcttcgaattggctatcagcactgcattcgttagaatttgtggataaatttgttaacctagttgggatcgcagtaggaatttgggtaattatgtattgtgggtgcttctgacatctgagcatcatgctatatggttgtggaggcgtgatttctattcttgagtactagttgtctcagtttttttttctagaatgactagttctctcagttgcaatgtcgaaatgtatttgggtaaataaaagttaggtggttagtcaacggtcctgtatcttattcagatttccatcgtgttagtaacaatgtacaatagtgtatccttttgatcataaacattgccatttcaacttttttttaatgcgctagtttatgttttagcgacactcttgagcatattggtctctagtattattttctgacacactaagaataagggaggttataagttataactgattcctaactctgggcgacaaataactttcgagtaatgttcccatacagcttatctttttcttttaagaaagaaaagggaaaacactaattaagcatgtgaatgtatgactgaaaaatgttaaattataggaccagtgaaaattttaatcataactggtgtacaatcagggggtggcaaaacatgaatccatatttaggagtggcaaatcacagtatcaaagctaggggcaacaaagcatgatattgaacattttcaggctagtgattacaatccaagtaatatatattcacctgttaatgttatgcatgttacaggctggtgattagtggttacagctacataattccctttttgccctttctgaaaagataaacaaaatgttttcaaataagtatctttagccacatatttgtatattgagcctggtgctatctttgcagggcaccatctcttaagagccttcgcctcatatcttgctatgatgtctccaatgaagggtttgcagaggcaataaagaagcttcctctgcttg

SEQ ID NO: 38 - DNA, 1998 bp, Setaria italica
gcaatcgtttatcctcaatctgtctaagcaagcaaaaagaatccatcaaaatgaggcaagcgcgcatgtgtgctcgccggcaagctgtagggaggcattttccgtcgagaatgcgcgccctccgcgagcctacttgccgccacgttccgctggccgccaatccatagccccgttgtgccgcctcgctcggccctgcctgctctgctccagacgcgtggactcaacccatgatctcgggggtgaataggacttttttccaaaagaatcatagcccgagagcgagaacaaccaaccctttcatgacccgtgcgggggatgcgcaaaaggaaaggaatttcgcgtgagagtccttgcaagtttcaaccgtcgctacaaacggtgagggccgaatttcgtgattcaaacggactgggcctaggcacggaaataaaactaaccccgagtaccctcctcctctgtccgcatgcgactcccctcctcgacgccgaaaccctagccgcgtgcaccggcgggaggtccaggatccagggaagtcggcacaggtctccggactagggcggactagcctcgcaccgccagggcggcaggagggcagtcgacagggtctgagcggtgggcaccaaacctccacagtctcgcagagatagagacagagactaagaccgattaaggactgtccgagaggtgaattgcagcatcttatgatattttaacttgcttttactgttaagattatatacatagccaaaatagaaacgtagggggtagggtatgatgtattaattaagcggggaattgagacattgagcatttgtattgtacagtggaacatgaagatggatgattgttagtcacattcgtatctgtatcttcaaagcaagtgaagatgatcagatttatggccatgagaagacataatcctgataagaagtagtattgtagtgtaatcttctttgaactactgtagatgtgtaaacttcttcaaggcaaatttccgatgtgattgtttgctttaattttttttaagacaccttattgatgtatcattttgcgcttttggcaaattctatacttgtatagcttggcatattacatttgtgttgttaaaaaagtttatgccaagttggaccaccccaactcaaaaccctggatgtgcctccaggctccaggtctccttccggcaccccaagtgccaacccaaggtacttggttctcgcagttttgcctctaccttgtactattgaactggcgtagagtggtgatcaatccccaagacttatatttattgatctcttttgtttgtgctaaatgaaccataacttgcttttattgttttgttctggcattgtctcttcttgtctgtccaatcctttactaatgctggtttatttccagttatcttttaattcaactaaaacccccgcaccacaactaattgatagacagggagtggggggatagggaatttaaaatctaaatgatccgtcaactaaaaaaatattgttttcttaattattttgtacaacaacaataatagcctttcagtcccaagcaagttggggtaggctagagttgaaacccaacaagagctacaaatcaaggtttaggcacatgaatagctgttttccaggcactcctatcccaggcttaattattttgtaatttataaaaattattccagagatatccattccagtctaaacaatttgaacatcatattttgcttttaatcttttatgaatctttgatttactaaggtgcccttctttgttcatttcattcatcgtcctagaagttctgggtctgcgattgccaaaaagttgtaatgatggctaatgaatttgcattactctgcactttaactattctgttcaaattgcaatcatgtctctagttgagcttgtattttctaaccatatatttgcatcaaattcataatgtggtcttgaaagatgtagtaatgacatgtgaaactggtgtttattctatagggatacc

SEQ ID NO: 39 - DNA, 496 bp, Setaria italica
gggcagcgctaccgctatggagtgcctaggcaccaccgtatcgggggccgctcaagggaggatagagggaggaggatgaagagagagggggaggaagagagggaaggaagacccaccaccacttgttgcctaacatgtggatcaagcgccacatcatgcgaaaccaccctcaaaacagctatgggacaaaaacaaacggtttagaagttgagggatgaccgatatctagttttgcatgtaagggatgaaactcggacaatagcaatagacgtgggaccttgaaaggacttttttccaaaataaaaaagacacaacgcgtaatttgggccaacggtcacaggccgtgggctaacatcctcttcggcctgctgcagcccaccaacatcatataatccgccgcaagcccgcgagctccatcatctacggtctaccgtctacccctgtccggcccacgtatccgcctcttcttcctccaaccgcgacgtccccccgatcc

SEQ ID NO: 40 - DNA, 1148 bp, Setaria italica
ggtgacgagcatggacagtggcatgcagcatgtggatgggaacgccgtaacaagtgtcgattccggaggccacgggggtgtccgggacctccatctcgggactcgattttcgctaggacctcctctggatgtgacttgtctcttctgtgcaccgatgcacgctgctgcggcgtcggcgattgcaagcatctctcgactgcactgacgggcctctccctcgtatgggtagcctagccatcaactttcctgccctgtttccttcccgcacgcaaggctatgcaacaaaacctttgttagctgccaagctgatggcttttgctcgcttggaggcgacaggtgttgatacctcccatgtgatcgttgcaacagagaacctcgtggagttgtgggagtactagcgtccacccatgcgttaggaacgcagtatccaaccattccaacccccttctggccttctcaactatttgtcaaaattgttaagttaactaaacaatacaaccctgcgttctttttggctcatattgttatttgttcgttccgacctatatagattatgttttatatctctacaatttgctcttgttgtataaactacatgttcaactgatccggttagaatgacatgataatgataatgataataataatgatggtggagggtgcatagtacaaactcccattccataagatggtataatttgttctagatatatagactttttgttctatgtaaataaaattttgctcaacttatattcactttaaaaaatggtagttaaaggatggtggagggtgtagcgttttgttatgtcagcttttgtatgattcgctctctgtgtataatatttttttcacttacataaattttgttctagttaagatggcagtgtgaggagagaagggggcagatgacaacacccggtatattctctctcttcttcctcttcttgagagaggagttctctgtctcgaagaaccttttcatattcttcttttccgcaggctccccggctccatgggccgcagcctgtttgtgtgtgaacggaatagcggcccagagaacgcgcgcggtcgacatggtcgcgaatcgcgatttcgctgccttttttcttttcccgtttttataaataaatcagcccgaaaaaagg

SEQ ID NO: 41 - DNA, 1603 bp, Setaria italica
gcataaatactggcgaaatgttccttgtgatctctgatactgacagtgttgctgttcagagcttcaagtgccgtgtgcatgttgaacttggggagctaccagcagtgagtgctagtttgaagttggaaccaaggcctagcttagctttgtatcacatcaccgttgggatttcctgttttcttaggttgggtttgaattatgtgctcctcttaatggaaaaaaaaagctatactaccaagttcgaattccgattcagacccggagacatggcgcagaaactgctgaacatacggcgacttgtttggatggtcgtggtcctcgagatcgcgagatagaggaaaacaagcgatccatgtggatttccatggaagcgataggtagtgtggacagaggcttgttgaattctattccatccactctaaacagtatttggagcgcccgctatagcactgtaaggtagtggacccaagatagtctatttggacttcgaagccattaatgtccactagtgcccagtatcgtggtcgctattgcttatgttagacagctattcgctacatttatggttaaagtgacataggaatatgaatcaaacagtaataataatatttaaaatgattattcaggtaatgacgaaaaattattgggatgacaagtgaattttttttattcattgatacgaggatttaatgttaatatacatccatacatcttaattatactatttatttatgattcgtaccatgagatgcaattgctaacttgaaactaactttttttaagtgagcttgatgttaatattcatatatcctctaaaattgtgactattttctgaattccgctatttggacttagcgtccgctatagcactcgctatccgcgatctgctacaccagcactaatccgctaccataccgctaaacgctatttagtaccttgcccagtggcccggagcgttgtttgtgttgggccagagaactgtcaggtacgcgctgcacatccttttgctggttcagtggttctgcattcatctttgcacactttgcagacattgggctatgtctccgtgtgctccaatttgtgaaaatctgtaaatggaagacaaataggcatgcatgcataatgatcatgttgtgtacagttggctatgcttctggcttgaataatctttgtttaattatcaacaaaaagaatctttgttcatatgcccccaaacactttcagccaacgtacttgtcttaagtacaagctctattgataatagatgaaatttagtattctacgagtacgctggagcaatattgctattatttgggatgtgctcttccatcttcgatcaactttacgccgcatgatgcatgtgtacacaatgagaatacttcttgctggtctagccactctgaaaatcatagcccatggatatgaacaagtactatctacttgtacaccctacaatggttaatccaaaaaggatcggaagcattgatagaaattatgagaactgcaggaaacagtgaaattgtttctaactaattagtattactgaaaaacatatccttcttcataacatacacaaactattatttctgatattaaaactttg

SEQ ID NO: 42 - DNA, 1588 bp, Setaria italica
tggtggagatgtattgtggtgaacatgaaatcagttgatgtgttgtttgtctgaatttctatgtacctggcacagtgaactggaaaatatcttaggtggaaagcacaagtcactagaccatttgcgctggattcacctgtgtgagaaaactgcaacattttcactttgttagctaggaagcaaggccatgttccattggctgcctggctgggcatttttaggactgctccgcttaaaaaaaaaataacttcactccaccaacttaaagctccactccaactaagaaaatagggagctacgaggttaatagtgtaaacttcagctccaaaaattataggaattggcgagaatggtctctcttgcccttggttgggattgatgtttttttttaccagctacgttaaccgactgctacagtaccgatcgctacggtaacactttgctacatcgcttcgcctactttgcagacttcattgtgcgcagctgaccgttggaatttttctggaataaaactccgcgtcattgtaataaaggatcacttttgaaaaccagcacgatcgtcatgtgttcgtatgaggtcattcggtagtccatgatactgaaagtgatttgtatccttttccaaaaagaatccgcagaaatcttcacaaagtaagttgatttggactaccataagaaatccagtgctctcaaatgttgcagaatagtttacgtcatacgcgttgaaaattatgccacccgaagattgcgaccatcttaaagcattgaaaattgatgtggcctgcgacattgggcccaggagatgaatcatccagcatttcagcaaaccgggctcaccaaggatgcagatgaccaaattggggtgaaatcggacgccagaggaaggggagatggcggcgacgacggaatagaagagtgtgagagggagggagaggcggcagcgatggaagatgaacaagcacggggaggtgtcaatcttttttccccctaaatcggtatgtgtaattggtgacattagtgagtaattttcaactaacttctattggaatgaaacttgtattttcgaagcaccctttgagaagctccagaaaaaatcttgaagttagctcctagatgcatattttttccttgaagttagtattattagagctagaaatgtttggcaagataattttaaagtggagttagaaaatctaaagcgaagcggtccaaacacgcctttgagatccgttaccgtcaacaacagaagcagagagcttcacgcccattttgagttccaaaaccacgtgatctccaaaatcattttggccgatatttcccagccccaggcactccgaagaccacaaatctcaggcgctccagacgctctcctcccaatcacggccctccacgtgtcccgaggccctccgccagcagcccatccattggaccatgcagataagacccggataaggcagagcccatcgctgccgtcaaatagatcacatccgtcccagggccgtccgatctgccacgcaggagatagcaccggaactctttcttatttgtaccccgggacgagccctctccacgccacacaccaccacca

SEQ ID NO: 43 - DNA, 1129 bp, Setaria italica
ccgatgtgattggatggacaatctttatatgtaggcatcttgtcgcaaacttggtatggttattccggtatctaaataacctcatattttagaaatatcaaatgcaaaatttatatcttagccagtttatcaattttagattactttcctaagtgaaacttgtttaactttgatcaagattatagaaaaatatattaacatctataatatcaaaatatatttcatggtctatatagtgaaattagtttgatgttgtatataattcaccccaactctccctaaataaaggaggagttgtggtgactctcccaatacaccgttggcttaggatgagattaatgagagactgtaaaagcaactctcccaataacagtgaaagtaatattagtatatccctattaactagttattggtaactatttactgggagactgctggaggtgttcttagttaagcacttcatgttcatgtatcgtccttttattaaattcttactagagttttatgtcatcattttgttctttcaaaattgttgtcactgcgctacatagtccattataaatcatgtatgcatagcatattaaacaatagtcatacatatttttagatgtaaaaatgaatcaattaatatcatattttttaaaaaaaatggccaaaacaatgaacggtaaacatattgtcaatcatcagtgaagacggagaaggttttacgactaagataaaagcaacattgcagtggggaacacgttggagcgctgatttttgcaataaagagcgtcctgaatcacggcaacttttaagtggagtctaatattttgtagcgaaaggttgcttgtcaccctcaccggcacagatcgcctacccatggctgacaggccccgagtgtctgcctacgcttgtgcccatttacttgggtcttacgttgttataatcttattactgtcgctttaatcacgagagacgaagaggttgtgcggtaagactagagcaacgttgcagtgcaggacacgtaggagcgcagatttgcagtaataatgtggcgtaagacagcgtcttggatcaatcattccacgtctcggagttaaatttttaattaatagcgaaaggtagctggtcaccctcgtcggca

SEQ ID NO: 44 - DNA, 374 bp, Setaria italica
ttagagacgaccggcgcaatttggttttttttcccacaacaactgatgtacacatcgttctcataaaggcttccaatcaattgtggtttgtgcattgcttaataaatgtcggttagtgcactatttcactagtaaaatttaggacatgctggttgttttcatgtaatttattcaaaatttcttgtatttcagttagaagaagaagaactgcacgaggaaaagaagaagaagaataagacagggcccagcagtgcattttcaaatcttttgttgccaatgattgagtcatctttacaaggaccacgacgaatcttctctccgaggaactcctataaataccggcctgcagctcggatccatcatcacacaacaca

SEQ ID NO: 45 - DNA, 3277 bp, Setaria italica
ggtgggttaatctttatgggtagtttagtgttggcttgcaactttatcatgaaaataggttgtatagtcacttgttggcttgcaactttatcatgaaggaaagttgtatagtcatgtgttcaaaagtttgcatctctaacccctgcatgtactaaatcgtagacactgaagctccaaaagtggaattcttggatttctctgaagaaccttcggagtttgaggagatttttgagttgatcccctgtgaagccggaccttcggacaacactaacctttttacagatcaaggcaagccccggtgcatctatacctacctactttggagttattatttcatgtgttcaattgttggttattttccgtatgaatgcattaagtctaggagttgattgaaacctattcttgtgcatgatcctacctgatttagaggacatctttgccacttgttcactaattagtaactatcctatgcttagcaatgcttagatacttcaagcaacttggattgcttagctctaaggaaaattttggtcatacatgttagttaaggaaaaatagcctggaaattggaaatgcagacagaagctagagatggtagttctgtttgctaagttaatttggttaaggcccgatcgttgtcttaacctttgatcaagtgagttctacctggttgcttactgggtatgggaccagtaaagcccggtaggttagttggctctttgatcgggaatatttcgtacccgtgcttgacgtgctggagaatggtaggggcatagcctgaaactcacatggagatcaggccagacgtggggtcccatgtggggtgcgtccctgggttcgggtagtcatgttcccaatttttgggtacggctaatagaaaggtcattatatgcaacctagacagttgtacatagctggtggttgggtatctcctgcaggatgtaaattgatccggatcgccgcaattctcggatatgaatgcacttgatcaccgttaagcatcatactgtaatccagttgaatataatgtttttcctagaatgaatatgctgtatgacttagttccactgagtgctcaaaatgttttattcatctagactggttaggtaacaactaaacaaaaataaaagaataaagttaaggttccacttatagtaagcctttccgcaaaaatgtgagtccgccagtatactaaacagctatcattcagtttttggaaaaaaaaaactatctatattggttaatcgggtcagtcttgctaagtaccctcggactcaggggaatccttcgttgctatttcagaactacagcaagagtccgccgagggagaagccccgaagaattagggtatttttacgagtctcataataccctagaaataaaactcagatgtttaactttcacctggactagtttatgttttaaactcttagaactgttctgacctgcattgttaagtttgtttcaaattatggttgtaataattcgcacctcgatatgtatgtaaaaatgtaatatttgttgataccttcccatcgtggaagtgatcctgatgtatggctatggatcacgtcgtggatgtttcgaggagtcctaaggacactcgacggaataccggacttagactgttttaagtgcgtttcggataattgttgttctgatagcgattagacgcgcttaaaccagtttaagttgggcggttccgccacactatcccttattactgattttggtttggtttgggtccatccgagatgaagaagaggcaagcacatgtactggaataatattcctggatcgaaggtatgagcatcacacatttaaatgctagtattaagaagaggcaagcacatgtactggaataatatccgagatgcaagtttacaacaataactctggcattgcatcacctgctcaacccatgtccaatcacatgataatcctaccaaacttagcacgagctgaattaaaattttccttaatccgttttatatatgtacaaatgccaccattgccacataaatgcataagttcttcccagataattctataggccaccattgctattttataagaatccttcagaattttaagctgaaaggaacttgactaaaggaggaacaacaaggatagagtctagtgctccatcccatgctacagattttagttcagttttcaaccaacaagaattaaaatttattttctagcaaatgaaaattcaagggtcattttcttaaggtttgaagttataccattttgcatatatatcataagtatacaaactttagccatataatttttgctggccacaccttggctactttataaagaccctgcacaattttaagataaaagaaattcggcaaattaaagggagaaacaacaaggaacgagtcaggtgccccatcccatgtttccatcgagatgaagaaggggcaaagcacatgtacttgaatatattggatcgaaggtattatcagcatcaaatatttgaatacgagtagtattaataactttgagcagcgcggaaggttcttatggcctcagtgatagctaatctaactttacaatatctctgacattgcatcacatgctcatcccatgtcacatgataataatcctaccaagctcagcacgagccacatgaaatttcttaatcctttttttatatatatataaatgcaaaagattggatcagagcaagtagctaagtatcctgcatccctcttcatgtccatgaatcatatccccgatgaaccacataacctccttttattctttcaaaacaagttaaaaaattttgttctagaaaatgaatttttaactctggttttcttaaggtttgatttttttgcgtctatatataagttctttacagataactgtacctttgctagtttatatgaatcctgcagagtttcaaggtgaaatttaaggaacttggaagtgggagaaactgaggatcgagtccagtgctttatcggtttatcatcccatactaatgatttctttttgttcagttgcatgttgcaaccgggatgacgaatcgaatatgcaaatcacatgtacagggtttactggcatcttttttggatcgaaggtacgagcaccgcatttgaatatgagcactgacgttaagcttcgttagtgggtgaggttttgcactgtgtaaatttctctactcgtgattccagtgatctgcataatgtcaacggccgtataggagcaactactatttaagcatccattcgcccatctatttcgatcaacgctcact

SEQ ID NO: 46 - DNA, 2020 bp, Setaria italica
gctaagtaccctcggactcaggggaatccttcgttgctatttcagaactacagcaagagtccgccgagggagaagccccgaagaattagggtatttttacgagtctcataataccctagaaataaaactcagatgtttaactttcacctggactagtttatgttttaaactcttagaactgttctgacctgcattgttaagtttgtttcaaattatggttgtaataattcgcacctcgatatgtatgtaaaaatgtaatatttgttgataccttcccatcgtggaagtgatcctgatgtatggctatggatcacgtcgtggatgtttcgaggagtcctaaggacactcgacggaataccggacttagactgttttaagtgcgtttcggataattgttgttctgatagcgattagacgcgcttaaaccagtttaagttgggcggttccgccacactatcccttattactgattttggtttggtttgggtccatccgagatgaagaagaggcaagcacatgtactggaataatattcctggatcgaaggtatgagcatcacacatttaaatgctagtattaagaagaggcaagcacatgtactggaataatatccgagatgcaagtttacaacaataactctggcattgcatcacctgctcaacccatgtccaatcacatgataatcctaccaaacttagcacgagctgaattaaaattttccttaatccgttttatatatgtacaaatgccaccattgccacataaatgcataagttcttcccagataattctataggccaccattgctattttataagaatccttcagaattttaagctgaaaggaacttgactaaaggaggaacaacaaggatagagtctagtgctccatcccatgctacagattttagttcagttttcaaccaacaagaattaaaatttattttctagcaaatgaaaattcaagggtcattttcttaaggtttgaagttataccattttgcatatatatcataagtatacaaactttagccatataatttttgctggccacaccttggctactttataaagaccctgcacaattttaagataaaagaaattcggcaaattaaagggagaaacaacaaggaacgagtcaggtgccccatcccatgtttccatcgagatgaagaaggggcaaagcacatgtacttgaatatattggatcgaaggtattatcagcatcaaatatttgaatacgagtagtattaataactttgagcagcgcggaaggttcttatggcctcagtgatagctaatctaactttacaatatctctgacattgcatcacatgctcatcccatgtcacatgataataatcctaccaagctcagcacgagccacatgaaatttcttaatcctttttttatatatatataaatgcaaaagattggatcagagcaagtagctaagtatcctgcatccctcttcatgtccatgaatcatatccccgatgaaccacataacctccttttattctttcaaaacaagttaaaaaattttgttctagaaaatgaatttttaactctggttttcttaaggtttgatttttttgcgtctatatataagttctttacagataactgtacctttgctagtttatatgaatcctgcagagtttcaaggtgaaatttaaggaacttggaagtgggagaaactgaggatcgagtccagtgctttatcggtttatcatcccatactaatgatttctttttgttcagttgcatgttgcaaccgggatgacgaatcgaatatgcaaatcacatgtacagggtttactggcatcttttttggatcgaaggtacgagcaccgcatttgaatatgagcactgacgttaagcttcgttagtgggtgaggttttgcactgtgtaaatttctctactcgtgattccagtgatctgcataatgtcaacggccgtataggagcaactactatttaagcatccattcgcccatctatttcgatcaacgctcact

SEQ ID NO: 47 - DNA, 3508 bp, Setaria italica
ttttgggacgcgagcagctttagagctgggatgacggcctctcttcgtgtgctcgaggcgttgcgtcaccctaggttttccctaggccagaggtaagatagttttgcctgcggcaacgcctttagtattggaaaccttggctgctttcttcaaggctttctgctccaaatgaagaatatttttcttcgatgcctcgcgaacgggggcctcgacgctgaagaaggaaaagacacgattcccccaggatccacccagcctcctttgaacctctttgtactccgaaggagattcggcaccaagaataaaatcaccacgatctttaaccttaatggaattgatctctacaaaatgaagcgcaggaaaagttatgtaacgaagagaaagcatgaagaaaaatcaatacagaggaggacaagcgtagagtcttaatttctttggtaaacttgaaacatttcgaccaatccgggcaagggataggccctttggtatcagtccagtcggagtccagaattgcccagctacagcggacaggccacactccaagcatgcggtactcctcgataatatcgcaagtgctatacttgcaggcaaagagacgaagcatcgagatgaaggcatcaccctcggcacatgcgggagggtcaatcttgtaatcatcatgaagagcctccatctttttagtgacgaggcagttgggctcaccagtctcttcaggctccacttcatgatagagctagtgttgatgccaatcgataggccacttgttgcgatatgcagccacggggttcaagactccagtgcgttacatgaagttgagacatccaaactgagcttgtttcccgaccactccattagcacttctctccaacaagtacttcagctggtgatgcaccttgtgagcattagtgaaactgactgccgaggacttgatttttgttgttttgcaaatccacatatacgtcgaaagatgaacgagagcgttgggtgtcaactgatgcaggtagatatcatacagacggagtatatctataacaattgggtccaactcaaaacgaagaccaacataaaggagatcacggaagatgacgaccttgttgtcttcgggtttcggaataacctcagaattgggtgcacggctagcaaagaccatcttgttctgcttcagtaagtcgatgtcattgggatgaagcaagcttcagccaaaaacaacagtctttggcataatctgatcaccatcgtcacccgaagggcggttgcattttggggccattgaatacaatgaagaacacaattaagcaaccaaaatgaagtcgtcggaagaataccaaacccagtgaagggggctttagacctccatcaaagaaagcgatagcggtaaaagtaaatggcacgagcccacacagggttatttataggtagagcgaaagagaaacagtaacaagggtcaaaagtcaaaaaaccattaaaaaaatttaatgaaggatttcgaataaggaaaaatatattaatcaaagggcaaggaagcaaaatcatgcatgggccgatcttggggagttccgaaggatggttgcaccatgtgttttaggatcgtaagttcagcccatcagaggagaagatggccctcgctcacgaggggctactattggggaaaccaccttgggaatctccttcgaagggagaagtccttttgacactaaccatgacagctagtttgctttgtggcgagctctaagtgcagggaagaagaaggcggtacgaagagctcttaggcgtatgagggctccttcggaacaaaacaatggctgactggcccgcgggtcttttgggagggccggcatctgactcgtcccctccaaggtttgtcctcagaggaaaggcatggagtggctcagcaaagagcacctcgacttccgaagatgaacatgcgttgaaagaccatgctgtccaccacatggattgaaaggaccgtacgaggagctagctggaggagtccatacaaaagatttgcacttgaagaaacccaatctgtagatcataaagccaacgtccttggaaaaaaccgagaaatgatacatggcctcatagaggtgaataattcgaaatcactatcaattcctccaagacatgattgcagaatgaggctaacagaatccacattgagagggatggaggatcgcccaaaagaagccaccaagaaaaactcattggaagagaaggcgtgtgagcaactgactggcaaagagaaactggattggatcatgcattggatctccaaacctagaccaaagtccagatcagagaggccacccatggtatggtagcctagaggaaggatcaccatgatcgccgaggaatggagagcacgacaccggggaggagggggacatcgccagtcaccatactcgcattcttttagcgtctgctcatctccacctaccctcccctagtcccctatctagttgcagtgcccaccactagatggtgccaccacgctaacctaaacgtcaagtctctccttccccggcaccgccccctatctagttgcaatgcccaccactagatggtgccaccacgctaacctaaacgtcaagtctctcctgccccagcaccgcccatcagcaatcgttgcctgcccacaagcacgacacgatggcacttatggaatcctcttaataccaacactactccaatccaaaaatttaacattgcagtttgattttgctctcgacctaaagaatcacaaaaattaatttaggtgtctggaatctatgaagtgcgagagagtaattaataaatcatgtatatatgtccagttgttgtttggggaaacctgtctctgtgcaaaagcagggtcctttgcccatgtacttttactatcagtcaacaaggcagcattctctcataaaaccacgaaagtaaaggaaccaagaccatcacagactccgtgcatgagttatgacatgtaaaggaaatcagccctggacaaattcaattgcagaagtccacagaagactccatgtgtgagtaatgacatgtaaagccaaatcagcctggacaaattccgttgcagaagaccacagtagactccatgtatgagttaagagtatatgacatgtagagcatatcagcgcctggacaaattcccttgcagaagtttctcgatccacctcagctagtcacgatgcaatcaccttactttagcaaaagcaaaacaaactgagatatgcagtcacatccttaataaactcgtcatactaccctcaccctattatcaaaagtaagaacaacaaaatacttttcccatgtaccccatgctgaatatcatggaggcgatcatgtgggtccaaaaacagttagggaaatctccaaatttgactagatgccatgtcacctccagcttatctaccctccaactttcagttctgcaaatgacaaaaaccttattgatctgcacggtgtttgtagcatataagcactataaataggacctagatgaatgctcagccca

SEQ ID NO: 48 - DNA, 1008 bp, Setaria italica
aaacgtcaagtctctccttccccggcaccgccccctatctagttgcaatgcccaccactagatggtgccaccacgctaacctaaacgtcaagtctctccttccccagcaccgcccatcagcaatcgttgcctgcccacaagcacgacacgatggcacttatggaatcctcttaataccaacactactccaatccaaaaatttaacattgcagtttgattttgctctcgacctaaagaatcacaaaattaatttaggtgtctggaatctatgaagtgcgagagagtaattaataaatcatgtatatatgtccagttgttgtttggggaaacctgtctctgtgcaaaagcagggtcctttgcccatgtacttttactatcagtcaacaaggcagcattctctcataaaaccacgaaagtaaaggaaccaagaccatcacagactccgtgcatgagttatgacatgtaaaggaaatcagccctggacaaattcaattgcagaagtccacagaagactccatgtgtgagtaatgacatgtaaagccaaatcagcctggacaaattccgttgcagaagaccacagtagactccatgtatgagttaagagtatatgacatgtagagcatatcagcgcctggacaaattcccttgcagaagtttctcgatccacctcagctagtcacgatgcaatcaccttactttagcaaaagcaaaacaaactgagatatgcagtcacatccttaataaactcgtcatactaccctcaccctattatcaaaagtaagaacaacaaaatacttttcccatgtaccccatgctgaatatcatggaggcgatcatgtgggtccaaaaacagttagggaaatctccaaatttgactagatgccatgtcacctccagcttatctaccctccaactttcagttctgcaaatgacaaaaaccttattgatctgcacggtgtttgtagcatataagcactataaataggacctagatgaatgctcagccca

SEQ ID NO: 49 - DNA, 637 bp, Setaria italica
cctgagagattagcgaacaagccggacgcattgcgcagattgaatagcactccgtcaaaaacggaccgagccattcaattccacatcgatgccctaactttccattgtatctacagcgacatactaccaccaggccatcgtatgtagattctgggaacacgattcatacccttctgtcgtcattgcccatagccgagtcaattatgcaggggaggcatggtgtcaaatgtcaatttgaatcagtaggagaatcctacatggattaaagctgtgggcacaatggaaaatgaggatacatccaattgaccgatgacagaattctccacaagacaacgtggaggggctagatcctattttgatggagttgccttcaatctgcagaacggtggaagaagcgtcggcttgattttgcccagggctcgactctcctcgcgcagagtgcggtgagttctacagtctggggcggttcgagtggatgggctactctcgataggactaacaggacacgcgtcgatatcctgcacggtgacgcaggggtgcggtgcgacaccgctgcaaagaattttttttcccacgtgcacggacggggcacggctatataaggtcatcgtttccaaggcttttctctgcgccgaga

SEQ ID NO: 50 - DNA, 2161 bp, Setaria italica
aagctagcacagattatattgtccacctactctgcatagcatttacaaagattatgccttcactttgacgtgaaagaatgaaaactggcacatcttttggtacatggatcggaccacctagtctccttgaagcacgtctgtgtgtttttcttctttcgaagttctagcaatggaatgctgagggaaaagaagtacaagaatggagcttctgaaactttgataatttcttcaccaggaaactttggtaacttctcaaagatctagcaagggtctgccgaccgaaaaggagtccagatcgagccggagtctcgattcctgattggattggaaaagagacgacggacgccgagattgatcatatccctaacctagctctgcctctaagctacaaaggtcgagtgcgaggctaaccgccgcggatcgattgagtcctcatcgcaatgaagaaacacaaagcatcgagctcacggcgcgcggaggcgcaataatggggccgaagcgaaagcgacgacgattgctgcaactggccgcaacggcggcggcgacggggctccgacggcggtgaaggcggtggcattgccggtggagttcctcaggtggttcctggcgcagagcagcgaggactaccgcgtcccggccctcgacgactactcgccgtcgctgggacgccgccgaggagcgggagacgacggtccgccgggtgagcgccgacgtccaggccacgaagtatggcttcgccgcgttccatgcttgggtccgcggcgtcgccgacaaggacggccgcgtcgtgctcgggcgcacgtccaaccctcgggagctgcaggagatcatcgacggcgagtgggcagaagcgaggtgggagctcggcatgggggatggagatggagttgtcgccggttctgatgacgctgccggcaaggaggacggtgagggcgccatggcgtcgtcgtcgtcatcgtccaagatgatgagggtcccacgcggcccgcatctgcaaaccctgtcgatctacctgtctctgatctaccagcgcatgacataagtttttggttagggtcgttcatgtcacgtatatccatgtcgtatctaacttaggcagtctcggtgggagtttcctgaagagtttcatggtcaataaattccatactacatgagcaattttgctgacttggtaaggtcgtaaagtaagatctttacgaggagattccattggcatccaaaatcccctacttgagtgaagtggttatgctcggagttaccttcacgcttcatgatatttgtatttcttaatatatacttaaaaatggactgtctactggtaacccaggtgttattctggccacaatcacccgggtgatttgtaggggaataacacccggttttgaagtggaaaaaaaatccaggtgctgcaaagagatctgtcacctgaaagttctgaacctaagattctgatcagacgattaacaaaaaagattatataaacaaggaaaagcaaaatagctgaacatattttttctatggtcagccaaagaacaaataattctgggttagtggaaactctaaagatgcaaacacagcatgcaaatttacacagatttaaaattacgcaatatacaaattgaaattacagtaacaatatcactgtaagttacttactgtatagtgtaaatcattaagaatcctaatgtatatgattaagaatcctaatgaatatggaatactaaagttagttactaatataatgtataacgaaaggagagaggcaggagagatccttggcaggcaggcagagggtttgaatgaggagcaggtccggtcgtcagaccgcaaactgctgccaaaaaattaaatgcgctgcgatctcgcaaagataggatagcaccccccaccgctgtgtctactggtactccgactcgcaattatcacggggcggcgtacccgccgcctgcagaaaagaagcccaactttgatttggatcagaacggaggaaaaaaaacagatcgtcagatcggacggtgccaaattcaggtgacaggagctcgtgaatcacccaagcaacgtatagcttttccccttaaaaaagtatgtcaacctatgtacgatgtagagttactagtcgtgacgaaacaaacatttaccaaacacacttgagcagatagat

SEQ ID NO: 51 - DNA, 1847 bp, Setaria italica
ctgaagattcctgtgggaaaccaactgatgtagtttctaaggaaacagagttgaagaagagtgtttgctcaagctagacctattaatcaatggttttgtcatgtcacagtcttctgtctcaggaacgaacactgcaccaattcagcagttgctgagctttagcaacacacgtgaagtggaatctcaatgtgctctgagagtctgagtttcacaatgagaagaaagaagtgaataagggatgtggagtaggagtatgcagtcattcatcaatggctggcactatagctggcatgttggttcctgatttacatctacagagacacatcaaactaagtttgacactatgtttgactaaatcagaagccaacctcatccgaatttaactgttggtagtattcccaccatctttggcatgaatttgctgccaaagttatatttatcatgtacgtgaacagattatatcactgattttatggtcattggcagggatgattggatcatttcaaagatgcaattttttctccttgtgacattattcacattagtcccagacatgatcaattggagtacagtaggaaaatgattctttgtacagaatttaccatcatctgtaatagacagtataacagatgcttccagtgatatgtccagatccaaggtttgcatgtgttagaaaacaccatgcacagcatcttggtgatagtggaactttttgtttgtattagtattatatctcccccctacaaaatgacaaaatgtttgtatacgcactggccgtttgcgtttgtatgcacgtatttctccaaactctgatagttacagcagtccatccaatttagttttatgcagtctgaaatccttttcatatacatttatgtgcttgcaaacattctgtagctgtccagcttttgtgattcaattgcaagatccctttcattttcatcgtactttgtttctttccttttcattgagatctttaggtgctatgaagccaatttgctccctggtaccaaagtttattgcaagaggcagaatttcattttcttcctttttgcccttcagtatttcagaactatttttactatgcaagatatgatatttgtaccttctttcttctcccagttggtctgttaatgtcagagcactttgtaaggccatgaggggggaatatgctgctgtatggttggaatcctgttggtggcatttttggcagggagttgttcaaattagtggtggatgtccgctgcaagcctgcaactggactccagaagcagcagcatattctcaggagcaaggatgtgtgtcaaagaaggaaccctgcatgcaacaaacaacggacggctggaggttgatgtgtgttaaagaaggaaccctgcatgcagcaaacaacggacggctggacgttgttatcaccaaaatactggctgtaaaatcttgtgttttttcgggaataactggcaacgggacaatttcatggatgcagtatatcagggcatctccgccgttggaagacacgtatgggctacagttcttggtgaaatccacccatagaaacccagaagccaggatccatcttaaggccaagaatgcgcagacaatattcaacggaccacgttgcacaaagaggaaaatgtttcttttgccagttttacatggtacacagaaaagagaggagaaataaagtatctgccagagccaggacaaaagagagggtggcaagaggattgcaggaatccagaaggctagcctccacctcacaattcatatctcttgtccttgtgtgcctccagttgcgcaaccttatatgccagccggtgcaacacttctcaagcccctaaggaaagatt

SEQ ID NO: 52 - DNA, 1995 bp, Setaria italica
ctgtcactgtctcatttgcatcaccactagctcgatcactagattcagagaacacgcgcaaccgaacgagctgaggcaaagatgcatgaacagaggcatacatgtcccgtgccaagcagctggaacaagcatcccgtcgccccaggttctcatgatctgatctgccatccctgcagctgcagccatcgtctcctggcccagccaaaccccccctgatgaatcgaggtaggtcgctcacatggacctcgtgcagtgaatgggattcaaggatcctctgaaccgatcgctgcaagtggttgcaggagggagagagaggggcctaaaagagggggcagaaaggagctgcgcgcgttgccaatccgagcgagatgcccgaaacgaggcgggtgaaagcccaggggagatcaggacgagatcgtgttgggagcgcgtccaaatcatcggagatcgccgaggggtcgtcgaggggagaacctactgtgaagaaagctcgtgcgctttgtcctggctcgctgagattgttttggtcggccccagcctcactccccagatgtggaaactgaacactggggctccattattgtgccctctgtatagaaaccttggcaggccaggggaccagattaggtgctcctttcctttcctttgttcattcatctgtgaacactgaacacaaatgttattctcttctgatcctctggtgagtttacatgtggaggcaggttttctttgctgatgcaaactggcttttgttcgttggataggattccaagcgatacactttcgaggcagttctttgcgctgagctaacatgttgttttctagtttcagcctttcaggacaactatgcttgtaggatatatcatgggtcatggccgaccatcccttggcaagcttcacatttatgctggcctaaaaggaggctcttgtaaaattatttcacaacagtttaaaagttcaacgaaatgataatacagtttcaacaataagctcaaaacatccagtgatttttttaatgtataataaggaatgcaagaaaaacattataataggttgacttggctagagaactatccatggtgtttactgatcggtggtgcatgtccatcatgcagactggcagtttccaacgagaagttcagttcatgcagccgttcaagagggcctttgttcctgctatcgtgggcggctactcctccccctgcaacctcggaggagacagcgggtgtgattcgagagaaccgggagcaaagtggagcgaggattagggcggcgggttagctggccggggcgaacggagaggaacaagattcgatccactgccctgcgccaccccctgtgttctcgctctagatctccccgctcccgagactcccggccaccgcccggccggctcacaccacgccactcgcggacacgctgctcctctcggctcccacctataaatacgcccctgctcatggcgctcccctctcagccacatgtgtcctcgatttggtagcttgcaagaaccctgctgcgaccccgtgttgcgttgattcctcctcctcctctctcgagatcctggcagggagtcgatccccggccgattgcgaaatcggtggttgaattgctcttcactgctctcggggtttgttgtctttgagcggttgctctggaatagtctgtttctgttcttgttccttctcatctctcccttgatgcatttctccttcttggactcgtagaggtatctgtccacatcgaccacaaaattgatcttgcggcctctctctagcttatgcggttctgaattctgcctgttcttcgttgatttgttctgtgcggtcactcttcagtcttcactgtcttgagttcatgaagctgggaactccaggcatatcagcccgcatttacttgttgaatccgtttctccttctgtgacgggagaagaagaaagaacccccggcagaactctcgtctcaattcgattggttagatgcaaagagatggtgc

SEQ ID NO: 53 - DNA, 1996 bp, Setaria italica
tggaaatgaaattgtagaatgatgtgaaataatagtatataaaaaacagaaaaaaaataggcccggagtacttgctttacgcatctgttagatgatcgatgaggcattcatgtcacgatctttagggatgagtgttcagtttggctattttaccttttatgaaatacaataatatatcacatacaaaccgctaatatttggaattctataaagtgagcaattttcaggtctgtcagacttgcatcaccactcaaagttcgtcaacctgtcaggcaaactcctgaagatttccaaatactctgccaaacatcattgcagcaggaatgcagtagaagaaacacattgtgcgtgatattattcgttcgcgtttggcaataatttttgcttgaagcattgcattggtcgaaatagatgtgccatcatgagtacgaaacctgaaattattctacctgaaactaactatgctaccagttcagatagaaattgtgacaacactcaacatgaagttccgctgcttgcatcgcatcggcattgtaggcattcaacattcgatggagcagagagaaatcaggagcagccgacattgttgccagctttgccatcaggagcagggagataacgcggcaatgctggtcgtgcgtgccaccccgtggacggcccttccttggtctactccagcacggtgcccttcgccgctgcctggtacgaaacaaggaggacaagaaggacctcgcgcaatgagtcgccattgcaggctaacgcggtgaatttgccccgtcgcatttccgacggggacggtgtacgctggatggatgacgacggcgccgaccgcgtccgctgcggcacggtatgactgatagaagtttgcatattgattattgattattaatcatgatccgcaggcaccgacgacggccgtgcacctcccgccgccatcctctagcgagtagagtggcaggcggagtctccagcagctcagatggatcttgcgatggtgtagatgccgctgccgccgccccagtgcacgtgcgagtgattggaaatgaagagacaaggagtaaaaggaaagaagataaggataattaagaaagatttgatatatttcaacaatatcattttacacattctccaatcatacctttatactatctatactactcatgcatactacctatactacaacttaaggttttagcagtatacaattaatctcaaccgtcggacccttacatatgagtcattttcgaatagtagtataaggtagtattgtgtaccgtaaaatacctctccaaatttcccaccagaagagcagcaggatgttcctcatcctttttaaatctgttatttctgtgtccaaaacccattcttgagtttattccaattgcattgtgccaaatatcatgttaatgtttttttaagtagcaaaagagggaggcatatcatgatatcaatatatcttaatgaggcatattgaataccaaagcatccacaaattgcagacctaaatcttgtgctaccaattccagttcattgatggagcatgatcgagtaatcttttcagctcagtttaggagaaagctaagcacaactccttgtatggtttaaaatagttacacttttttacttttcatggttttcctatattcaatatttaaaaacctcacaaaccacctctttgttgcagttcgtcaaaatggcaatgtttagtttctacaggatggtttcaattggcataattaaagatgctagagtctgagtgtctgaccatcgaaacgtcatgtggttgatttccaaatgaccagatcacacaaattttagacagtggagtgcaagtctacaacactccaatctccaaactcacaccctttgtgcctcattccgtttcagttattctcgcagcgcaccttgaagcttccctaacgcatgactccgttctctcccaggcctccctaaaaccatgccaagaactcccgaaaaggctttctagttcacagaa

SEQ ID NO: 54 - DNA, 1005 bp, Setaria italica
actagatctacacggtgacatcctggagaaagagacactgaccgtcggtcttgagtgaagtagtcgtcgaggacgccattggggatccttctcggatttggccgttggactaaatctggaaagagatcaatcctaacaaatctaaatcggattacagtacgcgtgccacagtatacgggtagatttggataacttcatgtcctcagcccgcatgtcctgaacgagcgggcctacttatcagatccgtatcggtgggaacctatgggatacccatatccctcatgcccccagcaatgtacaggtgcatctgaacttgaggttaccattcatgaacgtgcactctcgggctggcagtacggtattcacgaaacaaacccgtataagcccgcgatcaagcccaccagcccaatcccaacagtttcactttcaggcccaaacaagattctgcctcaaatttaggcccttcaactataataagccttattttttaaaaaaaaactaaaggaacatcttggaccttgcgttgacttacgattactgaaatggtctctgacgacctagcaaaatacaagaaacgaccaattttctgaaacagcgatacggatcaaatgaaaggcaaaaggaagggaaaatgataaactatagtcaaattatattgggtcaccagcacattaacatctgtacggctcgaggttacagtgtcctagctagaaagacggcctcactgaaacaagcgtgcattcatgctattctgttaggcagtatacatccatctcctcaactgtatacattaatcagtgaactaactcaacaattgcaagagcatacgttcatcttatatacttccttcctccgttttaaaatttttctacacatatatagatgtacaataatatctatgaacctaaaagagtcaaaacgacctacaatttagaacgaagggagtattatcccaacagccggagatgcatgcgcaagccaatcagcagagctgctcaatccgca

SEQ ID NO: 55 - DNA, 2256 bp, Setaria italica
tgttggtgccttgcgcgaatagaagcaagcggcgagctcggaacgtaatgcgacgagcttgcaaggagcagcatcttctaccactgcaagggatgcaagtctggattgttttggatcgacccaaaaactcattaaaacaaactaatcttgatttcaaagaagggagagtggggataaaaatgaactaattaaccagccagcctactactgcatacctactagtgtcaccacttggatgttggaactagcaactgtgctgtgtgttgtggatgcgaccgttgcacagcactagctgacccggtgaaagtaaaaatcctgtggagaatggctccaagcagccagcggaggccgacgcttgtccacgtctctctcaaccggaaaataaggggggaaagatcctgagaactggaggccagtgtgagctgcttcggcttagccgcttactacacgttgccaaaaggccagcgcggatggccacaactccaaatcctcgcccagctccgcctcacgctcccgccatcctgttcacaacacgacggcctcacaatttctttttctttttcttttttgcaggagctctgctatgctatgtaaagaggaaaagcaattcaaaatcttacaaagtcgatattgcataaatattagagctcacactactcaagttagaagctaaactcatgggtttggacgcctcacaaatttgggaggcgactggtgagtaacccacccaccaatcgcgagggcaccctctcatcaaaacaacgttggtgtttcttttttttttttactaaatggcaggagctctaccttattaataagaaaagattaaaagagtttaaagatcacaagcaaacggcacgccgctgcaaccgcccaagagtgcttcggcagacacatgtcgagtgttataaaaagagctatgtgatctaagttagggaacaaaacgttcgtctatattgctctatgcattcctttgttcgttttgccacctgatgggccgttagaagcttgttttcaaaaattctcctgttaccctctttccacatattccacaaaatgtagatggacatttcgttgaaatcttactgctgatttttgtggatatatacttttccaccgcctcccaccaatctctgacgttgtcgaaatttgaggggtgtgcttgctaaggaagcccacaaatatctctcatatagaaacttggttctagaccgcttgagcatatgggcggagtaggaagaggtgttgcccggattccattggcccattgcataatgcgcaagaggttttggtgcggccatcctctaagtgcgaggttgcctgtcgtgagaattttagtttggatgacaatccagacgaacagcttacatttattttcagtgcgggcacgccaaatgagattggctttgtgacatctatgtgacccaaaaaactgagcaccatatgctgattgggtggagtatttgccatcagccgtccacttccaagtattcgtatcctccgcctctaggtatgtcctgcaatctgatccgagtgagacaaactcctcaacttgagttgtagtcgtattttgttatgcaaggatttgatccacgtgctgttccatagctcttgtgccattgtcttgttttttcttctcaccagatcatataaatgtggccctaaattccttggtgcctcgccatcaagccaaactatggtgccaacacctcgccttctttccgttcgacgtccaacaatggtgccaaaaacaacgttggcgtttcacgtccaactggtagtggcagcacggactctgccgaaatagaacaccgaatatccatcaacattgctttcagggtctcgttgcaacacctgaggcctccaagcacctccagcccagcagcactagtcttctgctctctgtaacaaaaaaaaaaaaaaataccagcaccacgccgcgaaaggtcaccccgagaatcaaccgacgaaacgagaggggaggaagaaaggtcacaagtcacaactcacaaacagaaggggtcgggggcatgcacggagaaaaggccacgcatcgatgagcgtaacagtgaaggttgtgggtgacgcggccagccatcggcaaccatacgttgggctatccaaaatctcatccctcaaccaatcccgacctcacgatcccgcgccgcgcccccgcgcaccacaaacgcggccaccccaatccgccaactcgtatatacacgccgcttgttggctagcatcgtcaccttgatcgat

SEQ ID NO: 56 - DNA, 2058 bp, Setaria italica
ctgagaaatacatgatggaactttcgtaccaaatgtagttggttaaaactcctactgggatcagggttggtctgggctcagttcgaccagctctcacccacaattaaaaatgctaagctcagacttatggggcaataatggattgacggaaatccagatccagcggccgatcgatgtgtcttaatttgtagctagttctctggttactatttttcactttgcttcagtttccccatttaaattctttttaacttttgatccggccaagatgatctgatcaaactttacctacctttggggtagtcaaagtttgatcttctttgcccgaatacaaatattgtagtgattagtgaactcatctccaaatgtgacaaattggtcctctttcctgatgtacaacgagcggtttattgctccagtttgcactagtacgctagtttccgtagtgctgcagtagagtaatcacggcaatgctttgtttaagttgtcattaattgtgctgcaattgattaaaccagtgtaaccaagtcacccctcgccatagtagtggcgtgattaagcaaccgacaagaagagaactaaagaagcctatcatcatctcgatcctagcgttccaggacaactctttcagcaaggcccagccatttttgctctcatactaacctatactatagacatctaagaggagaccggaagacatggcatctctgacttctctgttacaagttgcttaggtaaactagatgatctgcttctacttcaatttgcgcccttctctacagcaagtggatagatatgatgcttaaggcctaacaattcatttgctactaatacgacttgcatttagtgattagatcgtgttagctgtctctcgttatcccaatcacgacgagtcatgtgattatggaagtcaactacgtacgaaaacctcgaggtcatcgcgcctctgcagtgtcaaccacgagtagaaatgtccagtccgtcagtggatgtaatgcttgcttgtgtcgattgtaaaacgtgctgttcagagttgatccaccaggccgtcgtttactttgcttcacagctagtatcgtataagcgcttgatcactaataataacaactccgatcccggcgtttaattacggcaatcgatgttgatggatcttttggttgtcgtgctgctagctgttcacgtttcagagatcagtttagtcaaatgcaatgcataggtaaggcatccacagtcatttgctgaaggtctaatctgcatactcatttggtaagcatgcacttagcaattaagtatttattatgaaatggtctatccataaaatttctaccatttttcaagttccaataaaggagcataatccaacaatgttacaatgtcatatataatatttgctcggctgctacttgaaatggcatgtgtaataggtgtttgagcttgtaagctaactgctgccccttccgttgcaaaacatatacatatatatagttctcaaatataattgtcctatatgcacacataagagaaccaatttaataagtgaaatttgagcaataattatggaattgtgctatggagctcattattagacacaaaagttcaacattcaagtaattcacaccagtaaattaaaagcagtgaaaacgtattgagaaccttaatatttcgatggatggttcttccttcattactttttaaaatgatgaatataaaactaatacattgataaaactgcttaaatcagagaaatcaagtaggtcagtttcaagggggccttctagacacctatgatcatattacctttgatgccctagattctccaatgatccatgaagatgccttcaaagcagctaaaattaatcaaagcaccagataggataggaaaacaagtacagagacaatttgttattacatcgcttcttgcatatagtgtagccaagtcaaggtgctccactgatccattggcttttaaaaatctccacttgatcttctactgaaccactagctactgcatggcctcatcaaggtactataaatagacatgctgctttcactcaaact

SEQ ID NO: 57 - DNA, 349 bp, Setaria italica
aacacaaagagccagtcatcctggtcaggtcgttttaggatcagaaataaagtgcgggaaggaaaaagaaaaagaaaactctagccctactcccattttgtggtaggcaagctacaattttgttcccttgttcagaacaggggtgtgcattcaattccttgcttcctcccattcccccatcccatctcctctcccctgctccgccgaagcagcaagccagcctggttcccccaacacccacagccatcacctcctccccccaatccggcaatcccccactatgaatctgatcccccaagaagcccccgcttccaatctctcctaaactgccccgcacatccctgccagc

SEQ ID NO: 58 - DNA, 1681 bp, Setaria italica
ggatgatggattgcttttgagaatgacttcttaaagcgtcaagcttttctgactgtgtcaggtcagcttcaggttgaaacttatgcttgtgctctcagtagtgtatatacctttggaccaacgttccgggcagagaactcacatacatcaagacatctggcagagttttggatggttgaaccagaaaatgcatttgcaaacttgcaggtgagctgcttcttgatgactaactttattactttgtggttcgccacctatcaaattggatcatggggttttgtgtggacataactaatgttaaacttgtataaattgtgtcacaggatgatatgaactgtgcagaaaaatatgtacaatacctctgccagtggttactcgatcattgtgaagaagacatagatttcattagcaaaaaatacgagagaaacagtagacataatcaaactgcaattgaccgtctgaagcttgtttcctcaacgcattttgaacgtatttcatacacaatggctgtggacattctgaaaaatacagaacaaggttgaatggggaatcgatttagcatctgagcatgaaaggtatgtgcaagttgtcagttgatcttactggtcttcacctgatttaccttctttgattggttaactgtaactacgtattctgtgaaggtatttgactgaggtgatatataagaagccagttattgtttataactatcccaaagaaataaaagcattttatatgaggctcaatgatgatcagaagactgtttctgctatggatgttcttgcgccacaggtatagatcgaattgttgaaatgtctatgatgctgtccattgttcactgaagtgccccacaccattctaccctcaatcagcatggatataagcagccagattcatgtctgctcttagtagaatataactatttctttctgccttttagaatttagatatctctggattcttttttcgccttttcaccaattacaaagaactaaaactgcatataactatattaagataacaatatttacattttctgaaatagctgtatgcttgcaactacatgctggatattttgctttgcctgctttgtatatagtttgaaagtgagctttgtggccgatgatttctacctaaccataaattattttccttggtaggttggtgaattgactggtggaagccagaggagcatctagatgtcctgaaacagaggtaccgacttgctcaatataattttgtttctatcaggatcaatattaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcat

SEQ ID NO: 59 - DNA, 428 bp, Setaria italica
caggatttaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcat

SEQ ID NO: 60 - DNA, 1280 bp, Setaria italica
tccaccgatcatcacacacagccagtagtgggggtgggccaagcaatcaggcacccggcaatgcgagctgatgcgtgatgatggtgctaccaacaaactgactataaaatttctgatttgaaagggattggcctcgatattttattagctccccggcttttgtcacgacacgttagcatgcgtgccttctagaagctagtccgggtattaccgctagaaagttcccgaaatgaagcatttaccacccgtaaagctcatttttctttatgatgagtagacacggtaccaacattgaggaccgattggttggctcccaaaatctgccctgccaaactagggcaagttcataaattttgacattcgcttggttggcaatcaattaaatcctattctaaaattcttgcctaggttttgatataacatgccctatattttggtctactcaaattttggtatggtaaattttgaacaccaacaaatcaggctattatttatcttatctctttctcaatttcattacacagcaaggcagtaattaaaaggaccgtatatacaatggatgtaagaataaaatgtataagtagaaatatattggcatgcctcgtgctggtgcatgtcgatatgctctcaattagaagttggagacaggttatgcttaggatagtcccaacctatgatatctgtgtgtctatactgccacataagtaagacatcactttagaaattacattctacaacctataatttcttagtgtggatccttaattaattcatcatctctcctctcaattcctcatcaattatgaagacaccatcttcttccaatgcaaatttaacactgtctaggatctaggttcaggtgttgatactgggtcttgcatgagatccagtttcttgttcttccaattctctctcatttaatatataatcacataagcaaaagatcctatgtagctgcacaattaatgctatggaaactatcctaatcggagggttgggactgctcctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacg

SEQ ID NO: 61 - DNA, 275 bp, Setaria italica
cctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacg

SEQ ID NO: 62 - DNA, 655 bp, Setaria italica
tcgatgtggcatgaattttagtccggactaaagatccaaacaccccttaatttcttgggttttggatattcctcaacttgaaccatcatagattacatagtccaagcttcttcctcaaatttttgtttttgtccataattttaagctagcgaactcattaaccaactacccctagcttacgaaagttgggatgacacaaaaacatggtggaaatccttaggaatgaataaaggacattttttggtccgtgcaaaagtgtgacttgtacttgaaggaaaattattggacctaaaaatagtttaaaaaaatgtgacactagctcgagagaagcaagcgaccaatagggattgtccaaccagatagggtgatactatagagtctatagagacgaagcgaaagcagatataggctggtggaatggaaagggatgttaatcctgccgagggtgtaactaatggaaaatttcttgtatttttcgtaatccatgctttggattacacagcaggccaaaacgagtgacaacacgtcactaatagttgttgatggttgcccatttaagtaaaaaaggttacagatcaccaaaccaaatatcaccgcaaaataattggccctataaataggctgcccggcctgcataacaatcgtgccttgctgt

SEQ ID NO: 63 - DNA, 1758 bp, Setaria italica
ccgctgctcaaaacaagtcaacgttgtggaggttctacaagattgagaggagtactaggcatacgttttctccggtcaactgcctgtggagtcaccgtgcttgttgaagatccgcagcgataataataaaattttgtgctattgggtttaaaagactatcggtcaggatatactctctttacgttatgacattgactatgatattcactaaagttgtcgcatgtgtgtaatttgatcctaacgcacatgtaatttatgcatgtggttttacctttaaaactgggtgtaacattttaacactattttaatatatttaacacagtaggggcctcctctactgtatttaccttaaaaaaaagataacaaaaaacgcatgcattgagtaagcagaaatgctaaaatggcgtgaagaagaggtatagtctcacaaatctttgtccaaatggactaatggtctaaaaaaaagtgaaaatgaaccttagatttcctggagaattaacaaaaaagaaactttgatgccaataacgattttcctccgggagagactatgcagggcacttgctgctccgtttctttcaacaatgaattccgttgggaaccgtttcatgcaagttgcgcatttctttgaggttgtggctgacatagagtttagggtactaaataatcattggtttggccaatagattaaaaataataattcaactgtgctagaaactagagttaatacctttttcattgcttgcatgagaaaccctatccaattttgtacagtactgacgtccgcgttaggatggaactggtgtaagattgacttttattaatcggaactctatacaattcactgttttttgtgcaagaatttgaatacaactggtacaagcaatgtatgcaatcttaagctgtgcgatgatgtatccagtttaagcaatgagttggcatcacgatctgaaagaaagattcaaacagataaggttttcatcaaattcagtgcatattgtgcaagaaatttgaatccaactctttcaaggaacttaatcaattcaaagatgtgcaatagggaaccacttcacacaatgaactggcatcacagcctgaaagaaaggtttgaacagataaggatttgataaaattcaatgcatgttgtacaaaaagaatctgaattcaattcttgcaagaaacgtattcaacttaaatatgtgcaatgatgcatgtatttaagcaaggtatcacatcacagtctgcaagcaagaatttaaaaagctaaggatttcaccaaactttatgcaaactgtgcaggaagtcatattcgattcgttcaagaaacatcacaatcagaaaagcaagatttgaaccggccagcagggaacttatccgctgcgtaccatttatacaactttattcagattcaaatgaaaaaattgcaacttttgtaagtatataagcatctctgctataaaaaatatgttaagttactgttaataaagtcaaattgaccgggcaaacaattggatttcttttaattcatgcaagcttttccagtagcaacataacctttatcttgctcttgagaaagaaaaaacacatgtaaaaactggcaacgttggagtactggtattttcctgcactatttcagccaagtggccaaccaatagcgtcacggcatgtaaatgcctcagacgccatgcagttgtttgattgcctctcaaccactataaattgggggcacatatgccctctcctcggcaattgctctgtgct

SEQ ID NO: 64 - DNA, 1866 bp, Setaria italica
actatggcgggcgtggtgagacccccgcacgtggtgtttcttcaaggcgatgagagtgaggtggagtccaacggcggatgtggcgaggtccccgcgcattgtgttatcgcggtggcgactgcgaggcagcctaagagaggtccggattcggtggtatcactctgtcagatagagtgtggtgttgcagcggcactacagcggagggtctcgtatggcggtggccatctcggtgcagtgcagtctgtttctatcggttccctgtcgatgccggaccacgcctagacgtttcggcgagttatgagcgtggatgttggtgggtgccgccgtggcgagcagagcggtgagaccgtgttgatgtcccaatccaatcggtagggtgtgatagttttggtgttgagtggctatctgcattgatgtcctaatccgaccaggcgagtttgtattgtttttcttttcttttccttttatattttttcagtctgaaattctttttttaatataatcggcagctctccaatatggttcgttcaaaaaaaagaatttttaagaaaagatagataaaaagataaaccaaattctgaattgtgattcagataccctcgaaatggaagttggcctgtccacttaaaattgaacgcatgattccgtcaataattcagtgccgtcctcctgtttactctttaattcttattacgtgacatcggcccgttgataagccgtgctccttgtcgctaattcttattacgtgctgatagaggcgagtcaatcaaacgttgcactttgtaacccttaatctttgctaagagtcacatgaccccgtacatctcgatcgatcctcttttagttggcgcgcgggttttaccatgtgaagcaatgtgccggcatgctgctgtcgcaactagctcttcatcaagctatcgacagatgagatgcgctcccattggaaccgaaatgggtggaaattctgttcgattctgtcgtgccgaccgtgcgaaagtgaaaccacccttcccctcgccgcaggcatgtagtccgcgtggattttgaacaccacagctgacatatgcctccatgtccattcctgccgtgggaatctctgcacctggtctgcctagtcctacaggctgcggccgcaccatctaaatgcatgtttgaatatcagtagttaaattttatcacatgtcacatcggatattcggatgctaattagtaggactaaacatagctaattataaaattaattgcagaacttcggggctaattcatgagaccaatttattgaggctaattaatctatcattagcaaatggttactgtagcaccatattgtcaaatcatggactaattagccttaatagatttatctcacaaattagactccatctgtgtaattagttttataattagattatatttaatacttctaattagtatccaaatatccgatgtgactgtgaagtttaacacatgtgagccaaacacccccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgcataattagcagcttgtttattaagcttaaacgattgatcctactccttgccgaca

SEQ ID NO: 65 - DNA, 382 bp, Setaria italica
ccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgcataattagcagcttgtttattaagcttaaacgattgatcctactccttgccgaca

SEQ ID NO: 66 - DNA, 1061 bp, Setaria italica
cattcttaatagagcatgggctcgcttccatcaacgtcactcaagtgaattcaaggagcaacttcatatccactttgaattcccggtatgtattgaatttgcacatctcatgtcacttccttgaacccaacaaatatttcataacttcttttaccgtatatatagtgtttgagatagaatctgaagaataatttatgcggatactacgtatatgagtttatccatggctttgtaggttccaagcgtataactgaccatgaattcagagtacatatacaaatttcttaacaataaattagttctaattgttcagatccattgatctaatataataacctttgctaatgacatagattatgcacatgaaagaggaactcctcgagatagaaaaaatcagggcaattcaataacaactcagtggaattcttttagatgaggtagtaaatccagtaggagagttccataatgatggatcaaatatacatcaccgtcaggactcgggtccagaatagttgatctaaaatgttgaacttggagagttgatgcaacgtaatattattcatataagtgtatgcacaatatgtctatgtataatattatcttaattgtaatattatagatcaaatacaacttcatatattgcgtattcgtaagaaaaaaatacaaaatactaatatagaataaagaaacagaaaagaaaagaaaagaaaagaaatataaaagaaaaaaagaatttagtatcggttggtctccccagccagtactaaaggaacccttttgtactgacttagcaatactggttgcacaatcggtactaaaggggggtttggacctagtactgaaggcgcttcctcagcagtggctcacctctccattagtgttggggagcccactctatcgctttatcgtctctcttccatgtaagcaaaatgatacttggccggcctcctatgagccagctgagttgttattgattgaggacgcctcacagatgctttccagtagcaggccgataggcattatttaaacccttcgtaggcactaacccagcaatagcatca

SEQ ID NO: 67 - DNA, 980 bp, Setaria italica
aactccatgccgtggtgcctccacacgcgcagcctccgttgtgcctccttgcgtgcagcctccgcgctgttgcacctagctcgtgtgtggaccgctgcacctcctcgccgctatagcaccctccgctgagagcaagggccaacactgccctcgtgcaaccgccagctgctactcccgtagcccactgcccgagcagactcggccccgtgctcgctggatccggtcgcaactcatcgctgcatcgcgtgcgcccgcagcagatccgggcgagctcacagcagactcgggcaggcccatcttattgggccctgttgcggccatcctagctgccacacagggttccggcggcggcacggcagggttgagggaggaaagggtggcggccctcgggttgcgcggtccgccaatgccgcctctgagaaggagcgatgtggggttgtggatgccgtggccgctttagtgtacaactagttgcatccttatgctactacttttgtagattgctgttgtttacagctccgtaaatgctttatttctgtgttttcctctcatgattgtttttttaactattattgtatctctgacatttccctttcagtatattattttttcgtatatgcatagctgggagcctgggacatgtgcggaggtgcagcaagtactacctccgtccataaatctataacattttcattttttaagtcctaaacatgcaagtcagtacaagtgcgagtctacaccgcaaatacagatactgtttccctttcccaaaattgttttaatgtaggcgaccacacaacttgccctccacaacttgccatccacacatgccccatatgcgtgcacctaaattactgattactgagatacgcactcaatcacctgatcaaatataatcaagtgtagctcgatcgctaagccaggccgatgcactctatttaaacctatagcaaggaacttatagcgaagcaaacacatct

SEQ ID NO: 68 - DNA, 668 bp, Setaria italica
agagagctagccatcgtttcgttcctggtggtggacaacattcggcagggttgagggaggaaagggtggcggccctcgggctgtgcggtccgccaatgctgcctctgagaaggagcgatgtggggctgatgtggggctgtggatgcagtggccgctttagtgtacaactatagttgcatccttatgctactacttttgtagattgctgttgtttacagctctgtaaatgctttatttctgtgatttcctctcatgattgtttttttaactattattgtatctcttacatttccctttcagtgtattattttttcatatatgcatagctgggagcctaggacatgtgcggaggtgcagcaagtactacctccgtccataaatctataacattttcattttttaagtcctaaatatgcaagtcagtacaagtgcgagtctacaccgcaaatacagataccgtttccctttcccaaaattgttttaatgtaggcgaccacacaacttgccctccacaacttgccatccacacatgctccatagattactgattactgagatacgcactcaatcacctgatcaaatataatcaagtgtagctcgatcgctaagccaggccgatgcactctatttaaacctagcaaggaacttatagcgaagcaaacacatct

SEQ ID NO: 69 - DNA, 2249 bp, Setaria italica
gagatcagtggaaagctttgctttccaataccttggtaaaaattgctgtgtcgcggtgccaggagtttaccttctcgatctcatttacattccacatttcatattgcactttacattccgtgtttacctttcctagaattcttgcatgtgtaatttataggattggaacctagagtgcaaaactcttttgtagtagaaatagcaacacataaaaaactagtgcacatctagatagaaattgaaatacgtttttataggtgcatggagccttaatttttataacaccaaattcaccccctgatagagtgtcacagtcccttcaccgtcaacacggatcgattttgtgatggctgtcgtgttaggttgatcgtaagtacaatcattttcccattttgaacattcaaatcttcccaccaatttttaagtccgtgtttacctttcctacaattcttgcatgtgtaatttataggattggaacctagagtgcaaaactcttttatagtagaaatagcaacacataaaaaactagtgcacatctagatagaaattgaaatacgtttttataggtgcatggagccttaatttttataacaccaaattcaccccctgatagagtgtcacagtcccttcaccatcaacacggatcgattttgtgatggctgtcgtgttaggttgatcgtaagtacaatcattttcccattttgaacattcaaatcttcccaccaatttttaagtatttacctataatttctcttctatggcagcttcctgtagtggatgatttacctcttgcttgacgaagaaggtggttgggctgatggccatggcataaagggacccaacaaactcggcaccagtgatgatggcctgtagctggggagtaggaatataccctattattcccgaagagtctgagtgagaatccttgtggtagtagattgggtcaacaatgatttgcttttatgttcatacaaattttcagagagatcttttgctaaatctaattccatttggttgaagattactctttactttttatttatttaaattatttatgaaattagaccgaaacacatttcattttgtgttatgttccttgggattcatgtcagtctttggttttcatttcaaaatacacagatttcttccgaaatttgatgagaaaattctacagataattaaaaaatcgacgactacacaatttgtattagtgattggaatatcgtatgaacaaacatagtgacacaaagtgaatatgacttgtatgaatcaggcccacggagcataaatatctgcatatttgtctaactatccggttgctgtgacattgtgagctttttgaatttgccaactgatttgcgtaataagcttcttttaaagttatatgacgatttgcatattatctctagacaaattggaaggaaataaaggcttaaattatctgataatataattctatattttctcatgtcttcttgagaacgtagtacgcgaaaccaaataatagcaatatccaagatcctcatccgttgtcgtatcgctttactatttgtttgatgagcaggaatggatgagatcctggccgaactctgacagatagccgagaactgtcacattggcatgtcacggcatctgtacgtttgatatagggggcaggacttgcatgttgctttctcgagttacacgttatgagctatacatgttgctttctcgagttacacgttatgagctatagcctataactgaaatcgatcaataattacataattctgttgctcttttcttggctagttcactaatgcgatgggacatgaaatctgaaggtgaaatggatgacaccggtggacaaccagttgcgacgatatagtagctcgccagatatggaaaagtgaaaattcgacagattttattatagttaattcaacacgtgctcctgaggatgttgatccctgctacagagagctagctagactgaactagctacctagctcgaaaacataactagtcattgaaataacgacaaatgtttggttaaagtttgattaaataattttcatagactaaaaagctgttgtcatgcaaaaaattaccttgttctcaataattttttagcatggcctcttttatttgcaattgagcttgtatgtttttcacctagaaaattactgaacatggttattatacagttctaaggtaactctgaaccataagtctataaatagagctgtagcgtacatgtttttctatat

SEQ ID NO: 70 - DNA, 1687 bp, Setaria italica
agcaaccattgtacactacgggaaatataatatgcataatggttgctctcccaccttcatgaggacagcctattggatgactcgcatcgggtgccatcaaagaacccatcaactactatattcatggactggaaggaaatgaggcaatcatctagctactacgtttttgggtgccttgatacaaagcgccttcatgctattatataggcacttaccataagtaccagtaaacaattaactcatacatctcgtagccaatgaactatgaatcagcagaaaatcattattttgtttgatcaactaaagcgcacgacctgtgacgtttggcacctagcccaagcattacaccgatatgtgatttaggtaatactcccacagtacattatgcataaccaacaccttaaattttgtacaatcagacttttcgtgatttgatcactatttgtataaacttatgtcactatcatgaaaacacctcagagatgcacattttcttggtacctgctcccattctactataacacctctccgtcccatccaagcagttggcctcttatttctttttggtgtatgtttctcagcctcgttcatggtgtctacctccatgcgaaacacgggttcagataagtgtgcaggtgcagtatctatgaaataaaggcagcaagttctcccagttcacaagagaaaatatcgtttataattatggtaataaaataatgtaggtctcaggacaaacaaccatatgtactcgcacatacaaatgtgattgcttcttgtaatcccaaattagtaatcgtcagtgcatgacttaaattagtaaacaattaactcatactccctccatcccacaaagagttattttaaaaaatttcagacagtatagtagtggtgagaaatgtatatgttgcccctaataactaatactagttgtcattaaaaatcatgcggtgtgtttagtttctcgatcctaaataaatgcacgcattgaaatcagagaaataacaccaattgattatttgattggctctacatacttctccatacttttttattattggtgtgagtgttgttttagttagatgagatttattaggaggtaaaggacactcttcgtgggacaaattgtagaatctaaaaggacactctttgcgggatgtagggagtatatctcatagacaatgaactatatgaatcagcagtaaccattgtttgatcaactaaagcatgacctatcatataaggctaatttaaattctgatcaatcagacatttcatgatttgactatttgtatttctaattctggagagtggatataagaaactatgtcactattatgaaaacaccctgagagatgcacattttctagatacctactcccactctactatgacacctctccatgccctccaagcagctggcctctaatttctcctggatgtaaggtttcttagcctcattcgtggtgtctctgtccacgcgaaacatgcgtgtgcagatacatgtacagatgcactatcgctttcctgacatagagtcctgatccgtccatagaaccatctctgtcctcgtggtccacgggaggatagctaaggccttattaattaacggtagcttactgatagtagctaagaaacacactatataataaccttcgtcaagaatgcagaacccatctaagcaaagcgc

SEQ ID NO: 71 - DNA, 2315 bp, Setaria italica
atccacacaagtactgaacgaaggttgcagagcgccagtcatctcgcttgacatgccccccagttcgctggtatcaggtttctcaacacccgatgatagaggagtactagtagcgtgctagtcagctgtgactcgaggtcagcgctggacagagttcgtatgctcgtaataatttacgctgtagatgtagtggactacagttttcgtgcgctgatcagcctagcgtgacctcgccggagttcacccgtggcgcaccattggctcgccgtccttttccgatcgagcaccaaatctccgcacgcttacacaggccgatcggatcgggacggcccgccgctagctggtcggtatagtagaaccgcccgacgacgtcgccggaaaccagtggacaggacacacacatacagcgcacgccgccgcatatttttatcggcccgtggcaagaatgtaaaccgccacccttgtccggcgctgccagcactgacacaggggatgcatcggggatgaccggggcccgtgacggcgacgcgagccgcccggctcttcacagccacaagggcgcaggtggcagcgccggattggtcggccgccgctcctcgtgtagtcgcgtgtactcgaggccagcgatctggaggccgccgttgagccaggtgtcgcctccgcaggatgcgtatgggcgtggaatgcgtacgtatgttgcgtaggaaaaaaaaggaggttcttcttcttcttacacagcagaggacgaaagactgattcggttcggtactgtgacctttgtggaaatggcggtcagggcaggcgaacgttccgtaaccctccgcttcgttgtcatgcttgtcttcgtcagggggagtgacctgggctggtctcttagctcatcatccggtaaagcgcggactcacagccaatgctaaggacaaacggacaataccgacccttcaattaggtcatgtggatgagtcattgggggaagggatcaggcaatgagaagagaacaaaatcacacaactcgatcagcaggacaactcacacgaacaaattaaagcaaaagccctgatcatgcaaagtactctaatcccaatgatcatctacaagtcttgtggagagttcgtggtcccagaagggtacaggattaggttaggggcgggcgattacatgacgcttgggaacgacagaggacatggcaagctgggctagaaacctctggagttttctttcagaaagaggggcgatgcatggaggaggacagctaatgccgtcgcgctcatccagcttgtagctaggttgcaactaatcgtgccccgcgataagaatctctatttgtacgtagacagggctcgctgcctggctgtgcgtgatgcatgcgacgcaatgattcgctgtccctgttgttcattattggctatcaagtttctgagcatctccattggcggataagtactactccaaattttctttttccagaagataacgctgccgaactgtttagttagtatatccacaccgtattctttgtcatgagctgaataaatgtccatgccaaatgtgtgcctcattttccaactggcaattggcagttggatatgtagcaagcaagggcatgctgacttcagtttagaaacttctggtgacgagtattctttttttggtttaaagaaacaagaagccctgattagttgcttgaagacgatgacagccatgctgacagcgcatgcgaagcagtgcaatagcacagggaatgcatgcactctggcaatattctgggttgcttgtttctagctacctgcaaataagtgttcgctactgcttcacgctccatgatgactcgtaacctcatgcatccaccctagctaattcttctgtcaacttcctagccacaccttagggtggtaatgtaccgccacgaaattaagctggaccactgattacaagcaccagtgtggttttgtgctttcagacgtcaggctagctcttaattcgcttaatttttttttcagaacgtatagtacgtaagcacagaacctatagaatataagctgaatagcccctccgattgatcactggccaccagtttggcttcggcgtgacataatggtgagggcttagtcggttgtgggcggcaaaaattataacccaaaaccctgtaaccagaaatggaacccttatccctcactaataatgtaatcaatcagtagtcgctaagcaagccatcattgaggcgatgagctcgccctctcccctgcacgagccgtcgacctcccgcgccccatatatacctcgcctctcccgtcccctcacacaccactctagct

SEQ ID NO: 72 - DNA, 2156 bp, Setaria italica
ctccaaacctttatttgaccagctgtttttttttcacatttccctgcaactattacattcggctattcattaacgcatacagcgtatgtttcacattaacatgtgcagaaacgctggggaccacggggtggaagttcaatgcctgggctgctgtaatttgcttactagcctatcttttgaactagcctggaactatacttcgatcacacaagcagtgcatgggatgttattcaccagcccattttttgttagattttggctggttactgatatcctttgctgtcttgcacctgttctgaagtgctgttatccgttgctcattaaattgaaaatgtggaaactcattggacgcaagtttgcaatttgtatactgtgtgtccgagagctgctctgttggcacgcaattcttttaacatctattttttttcccttactggctggtttcttcttggatgggaaactgtagacgttgggcagcgtgcgatgctgcaatactcatcaggatccggttgtctgtatgcatatgcacaaccaaattctctccttgtgtgatcaaaatgagctgaagaagagaatctgttgtgcggcattgacgaagagctcagtcagttgcagaaatccatcaaaccaaccggcgtgattaggacccgagccgtccagatcatttcaaccatgaaggcttataaattatgctgagtgccagcgtcatttcgtgattgctctatccttgtttcctttcgcttatagtaatctgatggtcgtagtgcacccaggtgtcgacctggcacgagcttttcatgactagagaatagagatgtgtgcctctcgttacaggtgagctctgaacaggatagcaaaagtaaaacgagtgaagctccagcttcaattcctgtgatggaatctcgtggaagatttgggacgagatcattgggcgctccctccccctttctgtctcgtgctgttgctgtcttcatccacgaaaagcgtctccagctgctctgttcaccacagcagcatgacaacggcagccactgatgagccctgcagacggttctaggcttctagctccgcggttggaggctcatttcactccgtgatctgaactcgcgctgcgtgcagtttcttgacaaaacttgctgtgacctgatgaaaagcaaggggaaaaggctctccaaatacagtgctcgttgcaacttgccccagacggccagacttgcggtttggatgattcaggaaagagccacgatataatgacctcatgacagggcgtaatacgctgtgctgcaacaaatttgtaccacgccgttttggtttcaaagaaatgagggatacagccaacgctggcgcacgatacgacatttaggttgcacctaatcaggcacctgataacgatcttaattagcagccagcaagtggttctcggatgtgcctctacgtggtgcttgcctgtccacgctatcattggcaagccaaattgctgattgagtagctctccattggtggagaggggcactccgttgccaggcaaccgatattattttaattaaaaaatcgattttttttgcaggcgcattgtgattatccagtaacaaagtacagcctccatccagcagttggaaacagagggatctagaaactccttggttccgagaaagagaattcgcatggccgttaagcacagaattcgctggtctgtgcggcaagcatagcaactgcatgcatagccacggttcacctcatcgttcaggcgttcacaccgtgcatcatcgttcaccagcccattctcagaagcagacagaaacacacgcatcacaattcacatcgctaatcgtcgctgaatgaagcttagccactgattaaaattagccagcctccccgtattaggcagagccaccggttgggctctagaattatctaacgatgatgagcgctttagtcggtcgcggtcggcaaaattataacccagaagcctccacagccagacgctccgctccgggggggcttatccctgacgaagaaaatcactaaacaatccaatcatgaagaagcagccgcctgttcctgtcacgaaccaccaccgtctctgcttctcactctcactcccggccccttaaatacctcgcctcgcctcggctgcctcgtcacagagctagcta

SEQ ID NO: 73 - DNA, 1393 bp, Setaria italica
gcgcagagtcacggcgtactagtcagctgccgagaggatggatgggatcatcgatcatgccaggatcgtcgtcgtttccttgacagtttttgaccttttgcgtcatgccgccccgagtcgtcaccattgcttgtgtctccttacgtggaaaattccatgaaccggccgaatagctttgtcgcaactgagctgaaaaaggagactgaaaatgatacaagtacttgatgtttggtgcgagatagacatcaccttttgaacggatcaattagtagtttgcagcgcaaacagacgattgaaaatgcaagcctgccagctgcactgatgggaaaagggcatcctaattcctgttcaaataaagggcatgattagcgggatactactacccatcatcttgtgcaaatttcttgagatgcttgtactgtttctgactgccgttggcgtctgacagcgagatgctgtgtgctgcagcagcaactctacggtgatattttccgtcgccatgcagtttttttcccgtgtggtaacaaaatacaagatttcctgtcgtcgccatacacttcaaaggtctagaaattaataaagcgaactctattttggaatgtttcgatgggactataacgattttctgaacgtctccagtactgatggttctaactgtcaaaattaaacttgtcgctttatcaatgtcttgactgccggtaactgacagatagtaacctatgcaagctttagtcaagaaacggagataagcacaactcagccacttgcacatcgcaatcactcggatcagttatagacctttctcacaggatttcaaccccagacaaattttgcatggctggcatggttgcattgcaggctaacaaccacgtgttgagtggagaaattgatgagatgccttcaggcttccttattctgaatattacatgtttttgtgctcttgtatctccttacctaatcgaacagaaaaggtgcagcaggagagccaaattctggtttgcgccaacaagaaagagagagagccagaatttgacaggcatgcttgattattctatattaaatcttatctggcatgcttgacaggaccagcaaatgttaaaaagatatgaaccgtacattgaagattgtgatgtctctaaaacatacagtatatgtcctccctagcctgcaagcactcgttcgtttaccattataatttggagactcgaaccatcttcatatgatgcatgacaaactaaccactcattactgatcgccaacaaacatgcatgcagctcacaccgctagcaaacagcaagacatgttaccaacagactgtcacgggcgcaaaaatgatcaaacgtgcaggctactatatatacgcaatatgcaatgcatgatattcaggccatcg

SEQ ID NO: 74 - DNA, 2722 bp, Setaria italica
ccatctctccttgaaagagaactatgtttaagtttcaacaagagacaacaatgcccttgtgaactgacaaaagagataacaggaaaagacaaggattcgaggaagcaagaaggcaagtgagcagtgaattgcagtactaccgaacaagactgatttttagtacagtacctaattattttggaataatgaataagagaggataatgttggacgaataaaaattgtgaacggaaaataactagatatgttttgggaggcactaacaagactttaatttggaagagagatacaaacatataaacatgttagtggatagataatatggtgtcttatgttagaaaagtacattattttttatggttattttcatagatctggaacattaatacaaaactaatcctatggatacaaaactgcatgaaaagtaatcatgaatttattctaatattgggcatcatatttaagtcacgttgcagaatttgaacttaaaactcgattcgtacgtggagaaacaaaaaagatcaaatctcattagaggtatattggaccatttaaagtagtttgggggaataaatcgagcctaagttttatttaggggttaagaggacagataaagtagattggtgatggtagtaaaatggacattttcctagttgtatctggtatgtactatttggcttaacatatattaagtcccaagtagtgcaaattgggattcaaatactaaattctctttacgtagagatgaggaaggagaattacaaagcagcattgccacagccttgcttcagttttgctcgatgcaagcagggtggagtggtggacaggcatggactagcggcacggaagacaacatcatgcatgtgcttccagagttgccaacggcaaaagagcagcaatgtgtgtagttcggccatgggctcggtcacaggtgggttcgtctcccagaacaggcaggagagggggtagctggctgagcatccatccgtgatgagcctaaaccgttgcgcaaacgggcagctggagagataatgcgaatatgtgatcctccacggcgttgccacagatgtcacggatcatgcatgcatgtcgtcatttagcagatgtttgagtctgatacacccttcacaccaagcaaattataaccaagataaggattcgaggaagcagaaggaggcaagtgagcagtgacaagtacgtccacaacacaatccagacgaaaacgaacacatcaatgccctcggcgccaatcgtagtaatgctgcaacaaacaaagtcctgtgaagacggtctctattaaatagccacacatggagccgatatataatccgaaagataatgtaataatagagaagcgtcatgttttttcaaaaataaaaataaaaataaactgggaacaagcccatcgcaaggccgggagcgagcttgcttttcagagtcagtgagccaccgggcgggagctgacgggtaggggaagaggaagacaacatcgtgcatgtgcttcaagagttgccaacggcaaaggagcagcagtgtgtgtagttcggctatgggctcagtcacaggtgggtttcgtctcccagaaccagcaggagagggggtttgtggctggctgtgcatccatccgtgatgagcctaaaccgttgcgcaaatggacacctggagcgataatgtgaatatgtgatcctccacggcgttgccacaaatgtcactgatcatccatgttgtcctatagcacatgcttgagtccaagtccctccacaccaagcaaattatagccaagacaaggattcaaggaagcaagaaggcgagtgagcagtgacaaagtatgtccacagcacaatccgtacgaaaacgagcgcatcagtgccctcagcgccaatcgtagtgtttccgcatcaaataagtcctgtgaagccggtctctattaaattgccacgtatgaagccgatgtgtggtccgaaagataatatgcaataatagagaagcgttatgttttccctgaaaaaaacctgggaacaagcctgtcgcaaggccgggagcctcgcttccgtcttgctttttcacagtcagtgagccaccgggcgggagctgacgggtaggggaagaggaagacagcaccgtgcatgtgcttccagagttgccaacggcaaatgagcagcagtgtgtgtagttcggccatgggctcggtcacaggtgggtttcgtctcccagaaccagcaggagagggggtatgtggctggctgtgcatccatccgtgatgagcctaaaccgttgcgcaaacggacacctagagcgataatgtatatgtgatcctccacggcgttgccacaaatgtcactgatcatgcatgttgtcctatatagcacatgcttgagtccaagtccctccacaccaagcaaattaattatagccaagagaaggattcgaggaagaagaaggcgattgagcagtgacaagtacgtcgacagcacaacccagacgaaaaccaggcaacgagcacatcgctccgcagcgctgcccctcggccctccccttgcattcgtgattcgccgccggtcacatgccctccgcttgaaaaaaaaaaaagccccctttccatccgccatgaggcgtgcaatcccgtgcacacactcgccgactccccatccgttattttgttttttttagaagccccatccgttatttaaacccacccgcgcgcctcgctcgacctcgtgcca

SEQ ID NO: 75 - DNA, 1882 bp, Setaria italica
cacggaagacaacatcatgcatgtgcttccagagttgccaacggcaaaagagcagcaatgtgtgtagttcggccatgggctcggtcacaggtgggttcgtctcccagaacaggcaggagagggggtagctggctgagcatccatccgtgatgagcctaaaccgttgcgcaaacgggcagctggagagataatgcgaatatgtgatcctccacggcgttgccacagatgtcacggatcatgcatgcatgtcgtcatttagcagatgtttgagtctgatacacccttcacaccaagcaaattataaccaagataaggattcgaggaagcagaaggaggcaagtgagcagtgacaagtacgtccacaacacaatccagacgaaaacgaacacatcaatgccctcggcgccaatcgtagtaatgctgcaacaaacaaagtcctgtgaagacggtctctattaaatagccacacatggagccgatatataatccgaaagataatgtaataatagagaagcgtcatgttttttcaaaaataaaaataaaaataaactgggaacaagcccatcgcaaggccgggagcgagcttgcttttcagagtcagtgagccaccgggcgggagctgacgggtaggggaagaggaagacaacatcgtgcatgtgcttcaagagttgccaacggcaaaggagcagcagtgtgtgtagttcggctatgggctcagtcacaggtgggtttcgtctcccagaaccagcaggagagggggtttgtggctggctgtgcatccatccgtgatgagcctaaaccgttgcgcaaatggacacctggagcgataatgtgaatatgtgatcctccacggcgttgccacaaatgtcactgatcatccatgttgtcctatagcacatgcttgagtccaagtccctccacaccaagcaaattatagccaagacaaggattcaaggaagcaagaaggcgagtgagcagtgacaaagtatgtccacagcacaatccgtacgaaaacgagcgcatcagtgccctcagcgccaatcgtagtgtttccgcatcaaataagtcctgtgaagccggtctctattaaattgccacgtatgaagccgatgtgtggtccgaaagataatatgcaataatagagaagcgttatgttttccctgaaaaaaacctgggaacaagcctgtcgcaaggccgggagcctcgcttccgtcttgctttttcacagtcagtgagccaccgggcgggagctgacgggtaggggaagaggaagacagcaccgtgcatgtgcttccagagttgccaacggcaaatgagcagcagtgtgtgtagttcggccatgggctcggtcacaggtgggtttcgtctcccagaaccagcaggagagggggtatgtggctggctgtgcatccatccgtgatgagcctaaaccgttgcgcaaacggacacctagagcgataatgtatatgtgatcctccacggcgttgccacaaatgtcactgatcatgcatgttgtcctatatagcacatgcttgagtccaagtccctccacaccaagcaaattaattatagccaagagaaggattcgaggaagaagaaggcgattgagcagtgacaagtacgtcgacagcacaacccagacgaaaaccaggcaacgagcacatcgctccgcagcgctgcccctcggccctccccttgcattcgtgattcgccgccggtcacatgccctccgcttgaaaaaaaaaaaagccccctttccatccgccatgaggcgtgcaatcccgtgcacacactcgccgactccccatccgttattttgttttttttagaagccccatccgttatttaaacccacccgcgcgcctcgctcgacctcgtgcca

SEQ ID NO: 76 - DNA, 1757 bp, Setaria italica
aactgctactagcagcacaagcattctttatttttattaacaataatttctacaacatgtcattacaaatattttattcgcgagatgcgagggcacgccaaggcccggagtctcgaggaggacgacatcgtgagatgaatgcatatgtctccttgtgttgcaaggtcacgaatggaagtatacttgctagggctcatcttgttcttcgacgagtggacgaggactcgaggagtccagctgcggactgcttcggcagacggacaccacgaaggacgtaccctccttccaaccactggtctgttttatccaagatctgagatcaagacgaaacataactatggttgcagcttcaattctttgcaaccgctgagtgcaaaacattttatgctgatgtaataatttctatgagaaacgataattacgatgcttatgtgtgagcttgccatatgtgcaattaatgctttattttttaagaaaataatatcttttctatggcaattttatccccacaatattagcccgtagcaatgcacaggcactatccctgtacgtatataaacgactatagctaattgaaatggcggagtatgccttggacccaccttactgctagttgaatcggcgaaattttccttctctaagcagcacatcttaaaaaaatataggaactgtttggctgcacagcactgcagctacagctgctgctgccagcgttttagcctactgtagcggttgcagcaaggctgcatgctagcagcccgaaagtagcacagctaaacaggcccaaaactttttcatatgaattttagatccgaacattgtgtcgattatttgagtatcaagatggttccaaataaaaaaatatgaactacaaagttgtacaatgtttatataaagtttatatttgtctaagttcatatgaaaaagttatatattttttttaaaaaatgtgctgctcagagaaagagaattccaccgattcaactggcggtaaggtcataaattccgttgtttcggttagatagccaattcaaatgtctatatgagtatagatttgcaaacttttattagaacatatatttttacaaaacattaaaaatactttttacaaaacatatagatttgcaaacttttattagctggctgctgcagctgcagccagccgaaagcagcacagccgaacatgcccataactttttcatatgaatcttaatctgaacattgtgttgattatttgaatactaagatagtttcaaataaaaaagtatgaactaccaagttgtacaatatttatataaagtttatctctttttgtgtttgcattcgtatgaaaaagttatatttttttgaaaaaaatgtgctgctcaaagaactggcggtaaggtcataaattccgctgtttcggttggatagccaattcaaatgtctatatgagtacagatttgcaaatttttattagaacatatatttttgcaagacattaaaaataaaagacatataaaaacaaaacataatcaactttccttgaagccacaccactcgccgcagccgcgctctcaaatttcctggagccagaagcgtcggggtccggagccagacgggcggcagacgcggccgggaaggtggggccccacagggataaggtgcgatgggggcgcgtgtgaaccccgtcgcgccacctgacggtgcgccacaggtacggtactgtatattccaacctgccgttcgtctcccatttcccgcgaactcacttgcct

SEQ ID NO: 77 - DNA, 1681 bp, Setaria italica
taatgcatatggttagacttcatagcatgcgttatgtaattatggtgattagatctagtatgtcaacccttcatgatatataaacacgttcacctatgttcgtgcccgtaaactacctacaccgataggggggtcgtgacaaggtctgtttccgtgtagggtgggggttttcgggaggttgaccggaggtagtagtttaaagattgctttggatgagatgcatgatgtgtttgctcgttggctagaactacaactagaagatatagccaattacaactagaagatgataggctcttgctatccttggtggtcttataccatatatatctgtggatgtgatatacccttattcatgatatcaatctttataacaagtttgccttcatatacaatcaatgcatcatgttaggattgcaccgttagattagatggaagatcctagttagttcgctgccgatccacggattgataaacattagacgaatactctaagggaaaagctatgatgatccgtgcatttgcggttcacaaattgacgcgctaactgccgtcaacaaacttcaacaagtaacagtgggaaacaaatgcggtagaagtgaagcaggaagaagatcgaggctttctagcaagagttttctttgggagtgagtggagagcattgcatcgttctaggtttgtttgtggaaaagtgcatggaaatgtatcaaacctgcaggatttgaattgacacttgttcagtagtcaaaggtggtcccaactatcttgtaatatgtctcgtgattcaacatttgaaaacaagatatgtaactggatatttctccaaccattcaaaacaagcctcaccaaatagaactctggtagataacttgtctcacaaggcttaaggtaccaacaatggttcaaaattaaatgtgacagataagtcgtccgatacgagcatttttgtagcagtgatggatcctatgtaagtctacgatgaacctatatagtagcttgatatgctagctttggtatttacctctttaaacatgttcatgtaatgaacagtctattttattagctagactcgaaataaatctcgacaataacttgtaggaataatatcttatggtgttttgtactaaaagcactgactactaattaataatccaagcatcctaatttgttaaggaaagtccaaaatgttacatgtattctttatgaatgtagcacaaagtattctttatgaatgtagcacaaaggataagacatgtatgggtgagtcaaggccacctcggcaacaaacaatacagaaggtagacttttaaaaatggccacccaagcttatgtggctttgacgagccaaacttatcatgccagcctcatccatatcaagataggaacaaaaaaaaccatgtcttctgatgtaatacctccatttttatttatatgtcattttggttaccaccaccgacgtcaaacaaacaaaaatggaggtaataacaaaatcaattaaaacaaaaaggccatgtcttctgatgtagcaaaatgaattttataacttcagctggtatccaaatcgacaaatgacatgtcatgtccagattatgaggcatcctccaaaattcagttttgcaaaggccaaaatcctacatgcatggcttggctcctataaataccaccccaatcaatctctaaccca

SEQ ID NO: 78 - DNA, 1681 bp, Setaria italica
catgcaccgtaaagttgatgatgaacacttcttaggcagtctttcaggggagagaagaacttcaactagccactgcaaaataactataacattcaattgaggggcttggtagcacttgaaatgggtctctttcaaccctcacttcactatcttgatatattcccttgtcgaggcgagatcgatgccttcacaatctttctactgctcattaaaaacttgggagctcgccaagcaactcctagctagccatctaggaggattaaccactgctctcaacccgtgatcgcacttgctttcagaatgccaacaggtagtgtcgtaggaagatgtatccgagcattagctaccaacagaaaaagatgatggaatactcagaatcttcaaaaaagtcattgtaacatgaaatcaaagtttagttttgcatttataaaattatagcctatcaacttctaacaccaatcggatgcaaacctaagtgtaggacgaaatcggaatatactgccttcaacccaaatccccaattccagaggctcaagtctttgccacagccaataggagtgtgccagcgagtcccttgcactgtacgccattgcagatatacctattgctctagactgcaatgggaaagtggaccacacttattagaactgtaatctcaaaaagctaccttgttcaaaaatcataatctgcattatgtctcaatggtagtgctgactcgtcagaatcaagaggtcacaggttcgacccctgcttctaaacactcttacctttttttattttcctccctttcttatcacagactaacttgtgggaccctgctagattttacaatgaattggaacactttatttctcaactcatgcttgcatgggggatcccccttggtttatgactttttgcacaccttatttttcaacaaatgcttacatgtggaatcctggttggtttatgacgttttcatggaccttatattgtcacaaaaccaccatgtaacaacgagtgacgatttctttttggctacagtggcaactttatgacgttccgtaactttgtcactaaatttgctcggatgtgaaactttatgacgtttttagccagaaacatcatagaactatgacgagaacaaatgtgtcataaaattttcgtcatagatcaacacatttcttgtagtgtaatcaactgtctatcttagctaaactcaaaataaatcttgacaataactattgtatgaatcatatcttgtggtattttataaaaaaactatgaatattaattaataatctaagcatcataatgtgttaagaaaaatccaaaatgatacatgtttgctttatgaatgtagcacaaagtattaaggacaagacaagtatgggtgagtcaaggccacctaagcaactaacaatacaaaaagcatacttaaaaaaaaggccacccaagctgatgtggctttgacgagccaaactaatcatgacaccctcatccatatcaagatagaaacaaaaaggccatgtcttctgatgtagcaaaatgagttttataacttcggctggtatccaaatcgacaaatgacatgtcatgtccagattatgaggcatcctccaacattcagttttgcaaaggccaaaatcctacatgcatggcttggctactataaataccaccccaatcaatctctaaccca

SEQ ID NO: 79 - DNA, 654 bp, Setaria italica
gggactgcccttattcatccaccggctggttgttagatttgttttccccttttccttcaaccggcttgtcaacttgcggtgttaataagctggttcccctttcagacgtgaggcgtttgtctatgccatgcaaattcagacaaaaccaagtcaaccataattttgttttttcatgttctttaattctgagatgcagtgtacaagcatccagctagctgccctgtcagttgatcacgaaattaaagcgtacgtcccacctaatgcctttcaataacccagctgcagcgaactgaactgatcggtttcccttgttttgacttcagtcccctagcaatctgctcgatcatgcacgctccatttgcatcatccaggcagggtcgtttcagctccaaacccggcccctaaattagtacctgcccggtttaacgaactaatacaaaaatgctaaacaacatcgctcatcagtcgtcaacgacaatcatcttagcgcttagctgtactcaatcatcagccacgttccgcgcccggtcgcctccccgatcgacatgccgaccagctgcccagataaacaaacgttcagaagccgcccgtccggaagccctagcacgctataaaaagccctgagcaggaacgccacctcactcacacactctc

SEQ ID NO: 80 - DNA, 500 bp, Setaria italica
ttccttttccttcctgcctttggccgatgtccctttgcctttacatccatgcacagataataaatctactgcacacaaaagaagatgctgatagaataacttggccactggggaacaagggtatttggtaggtacctcttcgaagcccatacatactctactggtcgctgcagcagacggtgtggtggccagaataacagctacctaggcccgtcgcgtgtctacacctgcatctatctgctcagctcaacgaattatattgccacgccccaccggcgatcaaaagctgcaaaaggcaaagaagcttcaaggagatggccagtgacaccaccctgtatatcagactgcttgtcccacaaaatatttgtttgtcccaagaataagctcacatgttgctcaaggcagctggatagctacgcaagaaacccttgggcaggctacgccccctctttccctggcttatataaaccctgccctacgtcccatcagcatcattgcag

SEQ ID NO: 81 - DNA, 1544 bp, Setaria italica
ttgggaacgctcaaagcaaggatctccgaacgctatgttgggcttgggtgggctcgggccctaagctaggagcctaaaacgcacaaccccaaactacatttgccaggcacacagaccagcccaatatctttgaggctgatcacatttcttagcatccctccaatcacaaataactgatttattaaaaaaatcacagtgtagtcaatgcatcaatatctctttaaatatttcaaattggattttagaaatattattttggcatatttttgcatgtgtttcatactagtaatcaattgtcaaattaatgcttcatacttgttatttgtgaaggaaaggaaaagttcttgtttgttatgcattttccctatctcttttttggataatgaataatatttcgactaactgtggatatacttcatgtacaccattaagttaaaagcagagatgcttgcacaaacgcacacaaaatctattcctatgagcatgcacctcggagagaatgagctggccaatcttacgttgttgtcgatgacatgttgcctagaataaatttagaaaaaaatattagcatccataccgagtcaaggacttaaatacaggtgagcaagcttcaccataaggaacctaaccagctgagctgttgagtccgttgttgatgttggctccatctaaatacatttgcttgttattcgatcaaacattagcaacttttagctacaagattatatgccatgagattagtgtgctcctcgaaccaatgctctcctgatcatgagagatatttaaagggaccatacataacacataggttaagattgtacaaagatggatattgattgatgcataaaaggcttcattatcaaatcatttgccgtccaaaactgaattcgattactatcattcaattgaaagggacctcacattactaaataactttataaaaaaaactctgcttttgaatgtctaaattttttgttcatagccctccattaaactccacttagctttaaatttcttcatcaaaattgttgcttttggcgctagagaaaaaaaaaatactttgcctttaccaacgtggccttgagactagcgtcttctgcatcatacaccgtcgacgtgtgtcggtcggctgtcacgacaaaagcaaaactccactgcccctgcaaaatgaacatgttgggagattatttaagcctgagccttttaggtgacaaagccaagctaatgcgcaggtgcgagcattatacaagcgcgccgcgaccctttgcctagtgctgtccgttctgtacgtgtacctgagctggtcagctccacatgcacaagtgtataggttgtacttaccctgcctaaagcttaatggaggaggtgagatcagagctggaaagaccagccatattaccggctccctcgcccaatcctcataactaatcagtttagaaattagcttaccagatcatgcttatcattccatttaattcatgcttggttacgttcgtcctataaatacgtgttcgtcttctcatctcgtcagatcagcacgaagc

SEQ ID NO: 82 - DNA, 1908 bp, Setaria italica
cctacctactaaaactttggccctttcttctcagaaatgttggtaagagtaaattaccagagtagaccgggaaaggggaggaggagaacataagacagctatgaatcaggagcctagtcaaatgagcaggtaaccttgtccatgtcacttttttttttggtctcctccagggttcagcagttgcttgggatgctaaaagtttgtgacctcttttgaggcatgtaacatgctatcagtatagttgctagggatataaaattttactcctctaccatatgcaagaagccacgaacctatctgctctttgcaatgcattcatgacaaactacagatgtgcatgcatgcctctgaagtcttctgacagtaactaccctaaaaaaaatcttctgacagtaactgccctaaaaaaaagtatgctgacagtaacaaagcacgctgttgttttgttccttgaaggaaccggccactgatacgtgctgcacggaagaaccaagctttctcccgacctgtttgagtttggaagctttcaaacaaacaacatccaagctaagtccttccaggaacctgctgctgctctcgtgacaagaatgtaggccatgcgagcacctaacacacggatcatcacgcgccgtgtggctcagagttggtacaccacatcatatcgcctggattggtctgtgtacttgtgtcccctgggaaaatcagtcacttatttttagacccctggattgaacacagaataatgcaatgcaaccatgttaagcatgttgtgcacagccgtttgacaagccattccccatctttcatgtagtgatcctcacctagctaatgtaacacggcaaaactaccctaatttggcagtagaactctgatgtatggaaccatgacgaataaatggaaaatcttagacgctactcactactcatcttgaatcccagaagcttgtgtacctttcattatcatttccacaaagacagggatactgatacgtgttcaatgatgaccgaaccattaaaaaccaaagaaaccaggggcatagtctgcatatggtcgtcattaatatagtaaattaagttcaaactgtaacaacccttgtgtataacaaaagaagctggactaactatgaagcaaaaccatgcttttcgccgaggctcctctgaactttggttgcttggtttcacatagtgttaaactgttaataagcgaggttatatagttcgggtgaatatattactactgggacgaactgatatctaccactaatctactgtaaagctgcctaattttgctgtagctagatttcccggaagggggctcttgtatgctgcagaggacatattcaactgatcaatttatagacagaaagttgcatattctatcattgtgcctagcccctagctatatgatcagcataatcagcaatccatcatatcttcttctcagtgtttttttttttgctgggcgaaacaatattctttatttcagttcaatcctgtttaagcagcacttgctgtttctgcagtaacctgtaaccgtactgtacctactgctgacttgtcgcttctgagtggaaaaatgtctcacctgatcagaaacgatttcttcgcctacaattatttgggactagaagctcaatgctgtccatgcaaatttcggttaaaactgaagcatcaacagtcaaaatgtcagctaaaactgaggcatcaacagtcatacttgcagccagatggaagaacaaccgtagcagttggacacaatgtggagtcgacctagctcgctcgtttgctcaccctcttattctataagcatcaccctaacaaatccctaaccaccttcccttcgttacacacatgctagctgcctccctccagctataaatagcacccaaagcccatctcatctggccat

SEQ ID NO: 83 - DNA, 3354 bp, Setaria italica
acgcaaatgacaaataatggttacaccaaaataggttaacgcaaatgacaaataatggttacacaaaactgcagtctaatctgtttatgaaatctatcatatacctgtagcttgaaagcaactgctagcacgagcaaacatctcgaatgacaaataatggtttctccactcatctgcaaataagaaaatcgctcaggcaaaatctcttaaaagtgcgaaaaatgtggagttgaacaaaataaatcactaccgacacattattctgaggggcaaaacgcagatccgggccacaaagcaaccggattagaagctgacaagcttggaggctgtgttgactcaacgagcttggagattggcagatccggtgaaggtggctgcagatctgtgcagggagttgtcaatgcacaagtactatcattctaaactaggattagcttctactgctcacctttttacaagcagtcaaagtcagcatgcggtggcaccagcggaaggatcgggcttgtaacgacagtttctgatgttaatcgcgtgcttcagagattgagtaaagtgctgttaattttccagaagcctaggaaaaaacacatctggaccctaccttaagcaacaacacgtcatgcttcacagaatagcagcattataatcctgtcaaacaataccacttttgcaatatgtcaaacaaaacacatggataaactgaaatgaagtcatccctttgaagccaagggtagtctcccgatagtcaacaaagtattcttcgacgaccatcacatacacacatacaactagcagcatcataatcataacagtgatctgaacggaattgttagacgatttacatttcctcgctatagatttattcaaaataaggccaaacatcttctatggatgttctaatcataactaatgtaacatcaagagaaaaaaggtaatgctttgaccaaattggtgaaatatggtaatataacacattataattatgaacctaatcaaagtgttctgggccacataaaataaattaaaagatatttgccaacgaatataatgccttcttttttaatcaatgcttgcttacaaattacaagcatatccctgtgaggggcacacaaaatctggccaccacatccgggtttggtagaagaaacatcatatcagaataacatatacattaaacagctctccgatcagttgcgtaataacatatcagaataacatcatatctagatatagtatatgtctagatgcataataatatctataaatttagaaaagctaaaacgacctacaatttggaatggagggagtagttgttttctttatttagagttcgatcggttacgtaatagtttcctttaattattcatggcagcttccactgacttactaagaaatcatagacaaattattttcagctgatgcatgacaaaaaataaataatgcttgcctacctactaaaactttggccctttcttctcagaaatgttggtaagagtaaattaccagagtagaccgggaaaggggaggaggagaacataagacagctatgaatcaggagcctagtcaaatgagcaggtaaccttgtccatgtcacttttttttttggtctcctccagggttcagcagttgcttgggatgctaaaagtttgtgacctcttttgaggcatgtaacatgctatcagtatagttgctagggatataaaattttactcctctaccatatgcaagaagccacgaacctatctgctctttgcaatgcattcatgacaaactacagatgtgcatgcatgcctctgaagtcttctgacagtaactaccctaaaaaaaatcttctgacagtaactgccctaaaaaaaagtatgctgacagtaacaaagcacgctgttgttttgttccttgaaggaaccggccactgatacgtgctgcacggaagaaccaagctttctcccgacctgtttgagtttggaagctttcaaacaaacaacatccaagctaagtccttccaggaacctgctgctgctctcgtgacaagaatgtaggccatgcgagcacctaacacacggatcatcacgcgccgtgtggctcagagttggtacaccacatcatatcgcctggattggtctgtgtacttgtgtcccctgggaaaatcagtcacttatttttagacccctggattgaacacagaataatgcaatgcaaccatgttaagcatgttgtgcacagccgtttgacaagccattccccatctttcatgtagtgatcctcacctagctaatgtaacacggcaaaactaccctaatttggcagtagaactctgatgtatggaaccatgacgaataaatggaaaatcttagacgctactcactactcatcttgaatcccagaagcttgtgtacctttcattatcatttccacaaagacagggatactgatacgtgttcaatgatgaccgaaccattaaaaaccaaagaaaccaggggcatagtctgcatatggtcgtcattaatatagtaaattaagttcaaactgtaacaacccttgtgtataacaaaagaagctggactaactatgaagcaaaaccatgcttttcgccgaggctcctctgaactttggttgcttggtttcacatagtgttaaactgttaataagcgaggttatatagttcgggtgaatatattactactgggacgaactgatatctaccactaatctactgtaaagctgcctaattttgctgtagctagatttcccggaagggggctcttgtatgctgcagaggacatattcaactgatcaatttatagacagaaagttgcatattctatcattgtgcctagcccctagctatatgatcagcataatcagcaatccatcatatcttcttctcagtgtttttttttttgctgggcgaaacaatattctttatttcagttcaatcctgtttaagcagcacttgctgtttctgcagtaacctgtaaccgtactgtacctactgctgacttgtcgcttctgagtggaaaaatgtctcacctgatcagaaacgatttcttcgcctacaattatttgggactagaagctcaatgctgtccatgcaaatttcggttaaaactgaagcatcaacagtcaaaatgtcagctaaaactgaggcatcaacagtcatacttgcagccagatggaagaacaaccgtagcagttggacacaatgtggagtcgacctagctcgctcgtttgctcaccctcttattctataagcatcaccctaacaaatccctaaccaccttcccttcgttacacacatgctagctgcctccctccagctataaatagcacccaaagcccatctcatctggccat

SEQ ID NO: 84 - DNA, 2599 bp, Setaria italica
gtatttaggtgcatgcctatctgtagctcgatggaaaatgcacactttacgagaagtactacttttccacgtgggagttagccatgagcgagcaccgtgactgatgaaaacatgggcccggttgggccttttcggcctcaattagcaacaaacttagacgaccggcaagggggaaaacggcccatatacaataacagaccttaatttcttctcctctcattttggcccgtcccatgttggtcggaggacatcatgcatgattcatcgcagagatcggacgacccacgaagcccatgatagacctcctccttccctcctctccatgttcttcacaaaaaagccccttctgcacctctcgtgttcatctctggaaagaagcccccgctccctccattgcccgacttcggcggcgctaccatgcaatgcaaccatggccaacccccctgaccgttgtgagcacgacaccccatctcttgcttgtccaaccaccctccaccactactgcggcgagcggcgccgcgtctccgtccgcccaagcgggcggtggcgcctggccgcagcatcagtagcaactagggttggagtgtgaatagaggagaagaggaagaataactctgcaattttggtcattgcaaggatctcaatgcacaagatgtggaacctcctagaagatggataggattttccgttgttggtgcactgacaagttgggtcatgctcataataggaaatgttggtcacacagccaacctgcaggtcggagggttgattcacatggttgcgtatcacgggcgtgatacgaatacccccggacggccggtgtacatgcaatctcgtaattgatgtactgtaccgaccggtagttcgaacacacatgtatatgtttgacctggctgaaaaaagattttcagttgcattcatgttccattatcggtcgattatacatgtagcgcgaaatatgtgtgtacgtgatacatgcatgcaatagcatagtagcagtagcaaaaatacgaaaaacatcattctggattccaagttttggtccttcatttttcgaaaataaaaggatttgcacatgcatggtctgccgagtttgtgtatgtccgactaaaggagtgctaaagtgtggcatatataggacgatttcaccggcatgcttatgcttatgctacggtgtgtaaaccgacgcagcagctagctagatttgtttactgctgaaacgacgccctgatgacagtgacagaaacgtggcaaagctaactgtaaccgaatatatagttcggtgcatatgcctgtgctgtgtatatcctagctagctcctatttcatttctagtatcctaatgggagccaatttcaagatccgttgacctagtatgtcgagagtgtttacagggatagagttacgccattgcgtgtattttaaaggataaatgtgcatacgtatatacgggcgtttgtatctttacactatgttttcaaagaaagaaaaaaaactaatacttatccctcctgctgcggcggcaatatcatatcaaaaccccccgtatgtttcaggaaaaatggatcgaataaaacatctggagtagaactgtagaatcaaacgcgcgtctctctttcaaaaaaaaaaaaaggaaatcaaacgcgtgtgccgcgcggcgatttttttaaacaagctcaacgcctagtggatgatgagagtagagacgtgcatgcatccgcaggtcagctgcttgagctgtacgtgcgcttgctgcgaccttcgcggccgcgcaccatgttccctccccctgttttaatgggagttgatcgacatcgcgtgcgtccatggcaacatgaacgcgtgcacgccgcgcgcgatgtcatccctgccgtcgtcgttgtagacccggccacccgggcatgtatgggaaatggaactatggattcgtacatacttctcaaaaatgcaaccgtaactttacagttcgatcttacccagtgaccaataatcaccatttgcgctctctttttcttatttcttatgactaccttgtatgctgaggataacgtaagaatttgattaagaatttgattgtgtgcggagctgtttaggctggaaacaatttctttttctaaacagtactctctccgttccaaattgtagatcattttaacttttctaagttcatagatattattatacacttagagatacactgtatctagatgcataataatatctatgaattacaaaaagctaaaataacctacaatttgagcggagcggagggagtattatctgcaaacacaaagtgcactgggtgtagaacttcccaccacttcatcaaagccccccggggcgagccaatcagacggcgccacaatcagagcgcgtgtgccgcgcgcgtcgcttaattaacaacaacgcgcgcgcaacttgatcggatatgatgaagcatcgccggtcagctgcttgagctgttacgtgggcttccttccggtggacctccgcgtccatggcaacatgcgccgccgaaaaccacggagacagtgtccctgtcacacttgtacccttccgcgagctataaattgcacccctaaccatgtcgcagagcacac

SEQ ID NO: 85 - DNA, 653 bp, Setaria italica
ccactaatctactgtaaagctgcctaattttgctgtagctagatttcccggaagggggctcttgtatgctgcagaggacatattcaactgatcaatttatagacagaaagttgcatattctatcattgtgcctagcccctagctatatgatcagcataatcagcaatccatcatatcttcttctcagtgtttttttttttgctgggcgaaacaatattctttatttcagttcaatcctgtttaagcagcacttgctgtttctgcagtaacctgtaaccgtactgtacctactgctgacttgtcgcttctgagtggaaaaatgtctcacctgatcagaaacgatttcttcgcctacaattatttgggactagaagctcaatgctgtccatgcaaatttcggttaaaactgaagcatcaacagtcaaaatgtcagctaaaactgaggcatcaacagtcatacttgcagccagatggaagaacaaccgtagcagttggacacaatgtggagtcgacctagctcgctcgtttgctcaccctcttattctataagcatcaccctaacaaatccctaaccaccttcccttcgttacacacatgctagctgcctccctccagctataaatagcacccaaagcccatctcatctggccatc

SEQ ID NO: 86 - DNA, 1090 bp, Setaria italica
ccaaaatgtaggccgatggcaacatgtcagcaatactctctctagccctaaacgaaggacattcagaaaactcagacaaattattaaaattatttatttatcatatttaggctaattgacagtcgttgcaaattataatttaatagagtaacaatgacaaaaaaaattgggataaattttggatcacataataactttattttaggaacggagggaattctcctatgttccatatggttaatactttaatagattaaggtactacctcctttcttaaatacatgacaccattaatttttttcattcatttgactattcatttatatataaatatttatgctttatgctaatagataaatctctaaatcaaattcaaagtaatttaaggaaagacatagcggtactcattttattttacttaactaatttactaaatagatattgttgtcaaaatttaagaaaaaaaagttaacggcgtcataaattttgaaaaaggagagaatatgttttcagataacacgcatgcttaatttctaatctttatcctttgattggctgaaaaagatacgaacaatgaacgaaatataaaaatagccgaatacatcaccatgtagatcgagaccggaatatttggtttttcaccgtctaaaaaagacttataataaacaacggctataatatctctcatgagtcatgattgtatactagatagaccccatcgtgatatacaaattaaaaatagccgtatacatcaatggtgagaccggaacattttgttttccaccgtggaaaagaaagttgtacaagtaccccaacagccgctatatctgtcatgagtcatgactttatactagaccccaccatgataaccttgagcagcaaaatattcacaggatcaaggatcaacagcaacattatgcataccacaaatcttgtggcagagttgcactggcaccaagaaccgaatccatcccacggataagatatgccatgtggcgggcggccagtgggtggaatcgacggggggcgaccgccgcgccggctggggataatccgcgcccatgcaatttgaggccattacacctcaccc

SEQ ID NO: 87 - DNA, 1483 bp, Setaria italica
tgcgcaggggttgggccggaatgggagttgctcggctcatgagaggtttaagggtttctattgatttgagtaagatttgtaatttaaatttgaattggttttcaaaattggctgggatttgagatgtgggctgggatagggtacagaaatgggacttttaaaaggatcctcaagttaggaatatttgactgagatgagatgggaatcctatagggttttggttgctattaatactcaaatggaatttgaatattatttctaggttttgcgagaggaaggatttggaaatttctatttctaaaaggggttctaagggaaacaatcacgtgcaacacatatgctaatattttgtgcaagatttatttataaaaaggttttgaatattcgggaagaaggtatgtgtttagtctaagaaaaaatttaaaaagtacgtattttaaatgctctaaaacgtggacgttacattttatgttgtattcctgttgatgtacatctcacacgtatcaaccgcaattgtattgtacacgttacctcatcaaaaatttatgtgaggaaaccttcaagtgaaaattcataaagagaaaaagagtacaacattaaatcttcttagctatataatattctatatttgctattctttatatgaatagtaatcaatcttcaagctttatacataaacttcatgattcttgcaataaagatctgcatgatctaaataatcaagtggtatagcttcatgttaaaattcaataattaatcaagttgattccttctagatataatttaaaagactttagatctaaacatgattaaagatatgctcccctcctagcgacatcttttgaatgtgttcaaaatgtcttagtcacattcttcataaatgcataagatggaggaaccgcatctttcccgcaatcggccattgctgcgtgctgcatcaacctccatggatccttattgaaaactactctcccgtggcctcttccacgacgtgactctactctcccgtggcctcttcccgcagacgcagaggcctgcagccgtgttgaaacccggcggggaccgtaccactttggcttcgatgtcgccaattcctcgctgtcccgtgctccaggttcactagcagccgcgtgagaaaaactggcggggctcgccgcgccgagaaaaatctcgccacacagctcacgagtcacgacggacaccgagaggccgagaccgcagaggcaaggaaagccgcaagcggcgttggcgagaggcggccaagcggaagctagctgccagcgtggatcgccatcccgccccgtcgtccagaagataaggagcgccgctaggtgccgacacgtcgcgccggacgagataaggataggccagcctggccgggtgacgccaccggcgaacggtgtccactcctgccacatccggccatggagccgctggctatttatatacgccgccggtggagaggagcctctcaagcaagact

SEQ ID NO: 88 - DNA, 2062 bp, Setaria italica
tatcggcgaccgctaagagaagacatttaaaataagtagtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttag

SEQ ID NO: 89 - DNA, 1563 bp, Setaria italica
agacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttag

SEQ ID NO: 90 - DNA, 915 bp, Setaria italica
gtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttag

SEQ ID NO: 91 - DNA, 2024 bp, Setaria italica
gtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttag

SEQ ID NO: 92 - DNA, 2087 bp, Setaria italica
gaaggaaagcgggatctccaaaaccactgtcgcgagacctgcatggggcagcaatcagatttttgggcagcgtcttcacgcgaccgcttggtgattctgcaacatccgcttcaacacgttcgactagttctgcgccggatcttgttctagataatatgttgcctgcttacttgtattatttgcttgcatcagtttttatcaatgtgtttttgcttcagataaaatctggaatattttttaggcacatatttccaacaacctacactcagctcgcaagtttaactgatatattgttcacatgcatgatattgttcgttgggagctcactcaaggtaagttgtatggctgcttttatgtttactcaaggtaagttgtatggctgcttttatgttttaagagtcaacactcggcaccaatcaagagcattttcaatctggttctttttttttttttgctaatttgtgatgatctggtttctagggtcaactgacttcttgcatccgcacagtacagtcagcttatattttaggagtatcgcgtcatgtgaatttcggcacaacgtacgacggtgcaatgtgccgttactgtcatccactcatcttttcaacgtcctcgatatacgtgttctatatgattccaaatttaacttttattggtattttgtacctggctgagtaatgcatggtcatgttcttttagctttgttaaatcggcaaagaatgatggagtattaagtactacgaacgaaaggcagcatggccgccacggccgtgcgtgtccgctagcctatggcacccgatacggcctcgctgggtgctgcggcagcgattaggaaatatggaaattaggataagtcaaaaggacgatttccccataagcaagttttttttatcagtggagaaatctatatatatacgattacaaggatgatacacatacacataggcaaatcgtactcacaaccaaaagagtgagccttctatcaaacatctataaataaattgctgaaagtacttgcacgtgcgcaagtcataggcactacgatgtgaaatcgatctagtggtaactacttcctctgatgataaatatatgtaagttcatctttttctaaatcaaacttttatctttgatcattaatatatagtaactcatgtagtagtttgaaaatatgagattaatgtcaacatatttattataatacatttcgataatatagatttttaaaattaaagtgacacaccataagcatggattttatttgtgatcggagaaggaatacaaaatttcgaagtcatcaattagacaaggcaatatacaaccgaataggtataaaatgtactggctattttttttctttttttaaaatatacagtacagacgcatatatacacatgcgctcaccctcaccctatgaatgtatgcctacacaacctacctgtatatgagcatcacgagagactaaaaaattactagtgataatataaatgcgagcacatatatatgcttgtcgtacattgaggcaccctaagatatgatgtggttccccttaataaccctatagaagagatgtcgatcttggctggaaatcttgatcgcaaatgtacatacccaacacatgcacacttgatctgtatgagtatcaattgagattgcgttgacatcacatactccaagcgtcacatggccaggctgatctccaagattattatacagtgatgcacacttgtcaaggtattattagcccgtaacacatgcaaacttgatctgtatgagtgtcaattgagattgcgttgacatcacatgctccaagcgtcccatggccaggctgatctccaagattatacagtgatgcacacttgtcaagctattattagcccgtaacacatgcacacttgatctgtatgagtgtcaattgagattgcgttgacatcacatactccaagcgtcacatggccaggctctccaagattatacagtgatgcgcacttgtccaagctattattagcccgtacgttgcgagcgggcgggtataaaacggaggctggtgagctccttatatcacaccaaagtgcacaagctaacctaag

SEQ ID NO: 93 - DNA, 1128 bp, Setaria italica
ttcgcccttactatagggcacgcgtggtcgacggcccgggctggtattctactgacccacggttcactcgtatgttatccatccagctcaatttttcacggataccgcaagcttaacagtgggtgactgtgtaggtgatcacttggattttggggtgagcaccttgagtccacccacaaagggtcttattatgccagtctcaatagtggatttcatgtgagtttcattagcattaaattctatggtacattagcaattttgctaacttggcaggattattaagagaggagagaaagtttcattagatgagagagcaatttcatccccataaaacccatcagactcagtgcaatgaaactgtgcacggagattggccttagaggctcttgaatcacaatcgacccgtcttcctactgaaaattctccagaatgcacgctatcagaagaggagcctctagtaccgtggttcgactctccgtgggagcaaattaaagtgatctagaataaaaaaatgtacaaaaaataggttgggtttctcctactaacttcagtcaaaaaaaagatagctaaacaagatagctcttgcgttgagtgtatggataaattgagttggcccgccagctgccttccctttcttagattatgtttggggttcttttcgtcatagcgtatttttcactcaacaatgtgtctccttatccctttcatccatgagtaatggctcttggaacatatcctactttagataggtgacaaattcagcttaaaaagatttagatccacatcaccatatcacaactttacagactctctttaataaagtggaatgcgtatgatgtgaccgatgccttcacatgtcttatggtgaacttgtgatgatattgtcacccacggtatcaagaaaataccaacaagaaaagtcacttttttccttttattaagtgcatattttgttgccaacacataccgtacaacctaagaaaattaatcactaaatgttgaaattgactagataccatgtcatggcttggttatctagataataatttgcttaggaaaagcaaaaatcatgctagagctatatgatctctcaagagtataaataggtcccggatatgtagccaatct

SEQ ID NO: 94 - DNA, 479 bp, Setaria italica
gggttcttttcgtcatagcgtatttttcactcaacaatgtgtctccttatccctttcatccatgagtaatggctcttggaacatatcctactttagataggtgacaaattcagcttaaaaagatttagatccacatcaccatatcacaactttacagactctctttaataaagtggaatgcgtatgatgtgaccgatgccttcacatgtcttatggtgaacttgtgatgatattgtcacccacggtatcaagaaaataccaacaagaaaagtcacttttttccttttattaagtgcatattttgttgccaacacataccgtacaacctaagaaaattaatcactaaatgttgaaattgactagataccatgtcatggcttggttatctagataataatttgcttaggaaaagcaaaaatcatgctagagctatatgatctctcaagagtataaataggtcccggatatgtagccaatct

SEQ ID NO: 95 - DNA, 1444 bp, Setaria italica
gttgtttggtagctgggtttagtagagatcaccaacttatctgctattatttctcttatgcatggcacagtactctaagacacaacaataccaatgaaacggaaatgttacattaagctaatattttgtcatatcttaacatcaccgtcacaattaaggggacacatcccagcagatgtcatgtttattttctgcccatggcacccaactggtttagggtgaggtattcaaattcaattttgaaatatccagcacgcttaatgcatattcatctacattatatattaatttcaatacaaaaatattctccaccagaaatttgacactctggatttctgatacatttcaattttttttttcgcagaagccgcatgagcttgcttaatgtttggcatcaggagaagagcataaacaagtctccttttccatagtgcaccgcataagtcagaacgggaaaagctttgaggtagccaaaggattcagcaaatctgccgcagacctcaggagctttccagcgagtataaatgcaccttcaattcacccaccatacttctttcaaatatactcgaccctactttatccaaagggttaagcactaataagttaaataacaggcaacttgtttggaacatatattctcctgacctatagcattcccaaacagagagaaaccaggcagtgtggaaatgtctaagtttctcttcaagggaaaatactgtggtgttggtgcatgacaagtcagtgatattgacctatcaacacgaagtcacagtctcatagataatgtcaaacaaaccctgtttcctgcagccaaaatattcttgcaaggattttaatttccgaagtcaaacaaaccttggctcccaaaatattcttgcaaggattttcatttccagatagaaatgtggatgaaagtctagagcaactccccaattttatttttttattttctagaaaatggtattgtgggccatttttcccctcccacctccatctccccagtgatccttatttactgagtacttgctcgtcccagaggggaggtcagagggcagccaatgagggatgaaagttggttggaagaagtagggggacagaaatcctgacaaaggcctaccacatctcccaccccatccctcctcggccctcatttctctcttgcctctgaaaactgaaggcaggacagtctcatagggcatgctcaaaaggacacaagatcttcttggggcacagtagtatatgaaaccacaagagggattcgacttaccactgtcggagaagactaacaaggaaggaagcaaaggcctaccatatggtatttatatatgccccttctctggtcctttcttgaacatgtcacacatggacgcgtgctaacatgcatgtgtgaacctatctcagtagctcattaatctctctttgcagcttagctctgctcactctc

SEQ ID NO: 96 - DNA, 917 bp, Setaria italica
tgtactgtcatattgtcgtggtttttcaattgctgtacctgatgcaaacgtaatgggtttactaatcttgcacccgccggcttcaaaatgaagagtgctaatttggtccacgtcaccatcaccggttcgaactgtctagaatggcaggcaaagatgattggacaggcatgcagggaaaaagagcaccgttgacgatgtatgcgagttcccaccattgcgagcaatgattatcagccacacgacttactcttcagagctaaccactgccatgcagagaaaaagtgaatcatattgtcatgatctacaacgaagtgaaacaatcaggcatgctaaagtgctgaaactttactgatctctcatgttggacaacaaagaatacgggaatacatcagcaacgcaactcttgagctttgcttgccgaatgaccagctagaatttccaagcatttacagaaacatgactttaagtttcagaaaaacaaatacaaggccactaaataagcgtggggataacatatcctccagatgacaggcaatctgcaacttgcagccattcaaatgtacgattaacaaaatatttaagcgccacatgagataatatatcctccaattagggcctttagtattgtcattagctcataaccatggtgcatcctcacatggacgctgcataagaagttcataatagcaacagacatatgaacaaagcatggtgcgcctgcccggccggactagctagtactaccaatcatggaataagctagtaccctaaatgaaattaaaatggtttttagcgattatccacgccgtccagaatactctaatccacaagttgaggccgcccatgaagccgcgagagggcgacgccatgtgtataaaaggggcctaagctgagtggacttgctgcatcagattagt

SEQ ID NO: 97 - DNA, 2108 bp, Setaria italica
gacttttcacgctgagaaactgtcaggaagctcaaacaaacacagcctatacagtgattctgtaccaatcaaaccactcacaactcaccaatgtacctgtttattttccaaatcaaccattgctgtggggcttgtgggttatgacttatgagtatgagcagtattttcccccctggaatgcaagtggcagatagcttctgagatctaccatgcaccctggtaaagctcctaccattttatttgcaatagtagatgcatataattgatggacacagagttctgaaccgtgagattttctttaacttcagagttctgtcactatgttaacgtggatctggagttttgcaggaactgtgaagaaggaaccgtacctaaaactaaaagtctcacgaagaccaaatgggcaagccagacagtcagagagacagggcttcttcggccaactggacaagggatgtgccatcatgtgctgagagattaccaaatccgcaatttgcagacgtgccttctcaatcagtttgcacaaagcgataaggtaaacaaccattggagcattgttaacagcagcctagcatggcaggatgcgtcatctgaataatgcggagggcaggacagtaggacaggacacctaatccctgcaaattctagtggctctgggacactgatcatggcccaaaagtgctaaccactgcattactaaaacgtgtgggtgttgcgagttccaagttggctgttgtcatggaatggtatgaaaatgcaaaagattctcgttgttttgttgagagttagtaaattgggatgacttcggcatgacaacagcacaaaccttacatatttggtaagacttgcaacaaaaatcaaaagaatgctagtagataccaacaaaaagaaaaaacagagctagcatgaacacttctttgatcacagttgatcaaaggtgtatggccctcagacaaagctgttgatgatggtcaaacacttttgctaccgaatatcgcagttgtcctttggtacattcacaagtttgatcttatcatcaccatcagaagttcagaaagtctcgatgaaaacaaatggaaatgaatactgcttacttagctcaaattcatattccgttgttacaggatacttaaaaaaggtaccaaaggctgttcctaatcatacgctgaagtcgttgccaccaatggcagctgtactgtcatattgtcgtggtttttcaattgctgtacctgatgcaaacgtaatgggtttactaatcttgcacccgccgacttcaaaatgaagagtgctaatttggtccacgtcaccatcaccggttcgaactgtctagaatggcaggcaaagatgattggacaggcatgcagggaaaaagagcaccgatgacgatgtatgcgagttcccaccattgcgagcaatgattatcagccacacgacttactcttcagagctaaccactgccatgcagagaaaaagtgaatcatattgtcatgatctacaacgaagtgaaacaatcaggcatgctaaagtgctgaaactttactgatctctcatgttggacaacaaagaatacgggaatacatcagcaacgcaactcttgagctttgcttgctgaatgaccagctagaatttccaagcatttacagaaacatgactttaagtttcagaaaaacaaatacaaggccactaaataagcgtggggataacatatcctccagatgacaggcaatctgcaacttgcagccattcaaatgtacgattaacaaaatatttaagcgctacatgagataatatatcctccaattagggcctttagtattgtcattagctcataaccatggtgcatcctcacatggacgctgcataagaagttcataatagcaacagacatatgaacaaagcatggtgcgcctgcccggccggactagctagtactaccaatcatggaataagctagtaccctaaatgaaattaaaatggtttttagcgattatccacgccgtccagaatactctaatccacaagttgaggccgcccatgaagccgcgagagggcgacgccatgtgtataaaaggggcctaagctgagtggacttgctgcatcagattagt

SEQ ID NO: 98 - DNA, 1593 bp, Setaria italica
tagcgtagcaggctagcagcctgaactctcgggtgattctgtggcgagttagcttgctcgctgcctgcaatggagtgaatattggcagtacgaagtcacacgggcaggcagagatttggaacatggtggaaacaagaaccatcggcatcgttcttctgatcaatatagtgattactggaagaatcaagaacagaataaaaccaaggcatcctggatctaccatgtcaatctttgctttcatcctcgtcgtttggagcgagcctgttcttgtttgaggcgcgctcgaccgtgccacgaagtaacaggtgcatgaggtctgcagtctgcactagaacttcccagctcccaaattcaacgaaactgaaaaaagtcattggtaacatcaaagtcttgtcttaggatagctgctgttcttgacgctggttagatttgtccaataaattacatgaccagcgcacatgtacttggtattcgacttgatgatttgtatgtactgacggacttgaataaagtagggggaattaggactcagaagtctacgatttttggtccaatatttgattgtgatgttcaaagtcgacgtctctttcgagacgaaattgtgatgcgtagaacaaaaacgacgcaatttcttttcaaaagaaaaagattaggggcagaacaattcaggatctgtttggctggacttataagccggctgaaaagctgaaacggttgatttattgtgagagaaaaacactgtttggtggctgataagctgaaacgaacaggctgtcagtcattaggctgccggctctggaacagtgcgccatcaagagatcacccgaaccatgttgagctcatcaacgtgcgccgctgttgtgctcattggtgtcgcggtcgtggctggcgcgcatctttcgttgcgtcttgtcatggattatccacgacggcagtgtcctgttgtttatgatgacggcacttgattcgccatggatggtgaaaacgaaatcgaagtgcggtcattttttattttaccagatgacgtggttggtgacctgagaggaacagacatgagaagatgagatcagcagctcaattcccacattgacagacgacctttggagcagtacaagagacccaaatgaagaatagtgcaaattacagagtatattagaacacgagaattattaagttttactcgaggtcaatgaaagaatttaggactattcagagcacaggctgtgttcaagtcctgcatgaaccagagaaagttcccaccaaggcctccatcagaggaacgaatttgcctggaactccatcactcaccagtcaccactcaccacttaccagcctaataaagcgtagcagacaatttggagtagacgatcatcatgtgcagtctcataggccctcttctaggaataaccgtatttgatagccaatccacctatgtggtgatttttttttcctttgtccatcggggtcgctttccatccgacgtgtctgcagtgtagcgcaatccatctgtcgctttctgctttctgatgaacgttccggttgacgccgctaagctgccttgtcctccttttctcccgtctgcacagggagggg

SEQ ID NO: 99 - DNA, 856 bp, Setaria italica
actgtttggtggctgataagctgaaacgaacaggctgtcagtcattaggctgccggctctggaacagtgcgccatcaagagatcacccgaaccatgttgagctcatcaacgtgcgccgctgttgtgctcattggtgtcgcggtcgtggctggcgcgcatctttcgttgcgtcttgtcatggattatccacgacggcagtgtcctgttgtttatgatgacggcacttgattcgccatggatggtgaaaacgaaatcgaagtgcggtcattttttattttaccagatgacgtggttggtgacctgagaggaacagacatgagaagatgagatcagcagctcaattcccacattgacagacgacctttggagcagtacaagagacccaaatgaagaatagtgcaaattacagagtatattagaacacgagaattattaagttttactcgaggtcaatgaaagaatttaggactattcagagcacaggctgtgttcaagtcctgcatgaaccagagaaagttcccaccaaggcctccatcagaggaacgaatttgcctggaactccatcactcaccagtcaccactcaccacttaccagcctaataaagcgtagcagacaatttggagtagacgatcatcatgtgcagtctcataggccctcttctaggaataaccgtatttgatagccaatccacctatgtggtgatttttttttcctttgtccatcggggtcgctttccatccgacgtgtctgcagtgtagcgcaatccatctgtcgctttctgctttctgatgaacgttccggttgacgccgctaagctgccttgtcctccttttctcccgtctgcacagggagggg

SEQ ID NO: 100 - DNA, 979 bp, Setaria italica
agtaacaaatcatacagtatttgccttctataaaggcagctggagactgttctccgaaataaatcatagcaacttaggagtgtttgatacgaggcgctaaacttcagcaggtcatatcggatgttcggatactaattataaaagtcaacacgagctaattacaaaactaattgcacagatggagtctaattcgcaagacgaatctattaaggggctgtttggatacgaggtgctaaactttaacagtgtcacgtcggatgttcggatgctaattaggaggactaaacatgagctaattgtaaaactaattgcagaaccctgtgctaattcgctagacgaatctattaagcctaattaatccatcattagcaaatggttactgtagcaccatattgtcaaatcagggactaattaggtttagtagattcgtctcgcgaattatactccatctgtgcaattacttttttaattagtctatgtttaatactcctaattagtatccaaacatccgatgtgacaggtgttaaactttaacagggcgttcccaaacacccccctaaagctaattaatccatcgttaacaaatagttattgtagcacaacattgtcaaatcatggactaattaggcttaatagattcatctcgcgaattagactccatctgtacaattaattttataattagactatatttaatacctccaattagtatcaaatattcgatgtgacatgtgctaaagtttagtagggtatccaaacaccccttctctcctttcctcttggtatgtttagcagttacccctggctcttggcatccgtttcgtcgacgtgccatggtttaacggacgggacggggacggccggctcacgtgaacaacgcccacgaggccgcgctggctcttgtaaaagcaaccgctccctccctagacgctagtgcctctttcctctctcctccgcccctttttatcgcccgatctca

SEQ ID NO: 101 - DNA, 723 bp, Setaria italica
ttcaatttcactggagatcgttccaccagagaaatcaccgtcggagtaattttaggatgaaaggcccaaaagcctaaatggcaggcctaccccagaggcccaagcgatcaagggtagctccgtactttcccgcgacggtgcgatacacggttcgaaatttcaaaattcgaacgggcggccaaacagccgttccttccatttccctgccgtcctcacaaaggctccccttccatccaccgaagtgaaaactaccccgactcaatgactcatgggctgggcagttcactttcatattccagtcccacatgtcagtgtcacgtcttcacgggcgcatgtgaagatcgccgagaacgagaggcgccggctccgcgggacccgccgccagctcaaacccaccgttgccggccgctgatcacgcaagcctcgccccgacgttcgaaaccaaacggccgttaacctccgctgcccccgcgcggcttcggccccgttcaccaacgaggcgggccaccaccacgccgtctaacgcgagccaaacggcggttaggtcacggcctcaccctcacgggccggccgcggccgcctcccctctcctctcgcgctgcctataaaagccgccgcggccgcctcccctctcctcacctcggcgtcttcacaaacgccagcgctccccttccactcccgatcgatcgccgctccgctccctcttccctcgcctccgcctcc

SEQ ID NO: 102 - DNA, 1492 bp, Setaria italica
actgccgcgacacgcctcactggcgggagggctccgagcgctctctccccggcggccggcggagcagcgatctggattggagagaatagaggaaagagagggaaaaggagagagatagcgcaaagagctgaaaagataaggttgtgcgggctgtggtgattagaggaccactaatccctccatctcctaatgacgcggtgcccaagaccagtgccgcggcacaccagcgtctaagtgaacttccgctaaccttccggtcattgcgcctgaaagatgtcatgtggcgaggcccccctctcagtagattgccaactgcctaccgtgccactcttccatgcatgattgctcccgtctatcccgtttctcacaacagatagacaacagtaagcatcactaaagcaagcatgtgtagaaccttaaaaaaaggcttatactaccagtatactatcaaccagcatgccgtttttgaagtatccaggattagaagcttctactgcgcttttatattatagctgtggacctgtggtaacctttctcttttggcgcttgcttaatctcggccgtgctggtccatgcttaggcactaggcagagatagagccgggggtgaatggggctaaagctcagctgctcgaggggccgtgggctggtttccactagcctacagctgtgccacgtgcggccgcgcaagccgaagcaagcacgctgagccgttggacagcttgtcataatgccattacgtggattacacgtaactggccctgtaactactcgttcggccatcatcaaacgacgacgtccgctaggcgacgacacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggaatggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcc

SEQ ID NO: 103 - DNA, 680 bp, Setaria italica
cacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggaatggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcc

SEQ ID NO: 104 - DNA, 851 bp, Setaria italica
  misc_feature (559)..(559): m=a or c.
cgggcgggtctgtgccacgtgcggccgcgcaagccgaagcaagcacgctgagccgttggacagcttgtcataatgccattacgtggattacacgtaactggccctgtaactactcgttcggccatcatcaaacgacgacgtccgctaggcgacgacacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggamtggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcccgatgccgcaagactc

SEQ ID NO: 105 - DNA, 2215 bp, Setaria italica
gttccatatatagagattggagtaaaaaataaaaaatagcatatttctatatgttatagtctattgttggtggatgtgaaaacaaaacatcttgcacaaggtgtccaggagccccaccgtcatgggtcaacgcggagagctggtatgaagcaacggtacaaaaacagtgctattggctaggagatgaatacagtttagggtagctgctgggtaagggactaaagggtatgggttactttactgaacctcaagtgcttgtcagcacctcggctcgtcgttgcaatgcaagctgtgcctgtgaccgggtcgcctgaaaggcaaggcaaaccacatgctatgatggctgctgcgccgagaaaggaggtagctggttgggaatttgataactgagtcagttaagtgtaatgggtaacttctctctttttctgatgaaatctcctcattatgatctcatcaagtcagcaattttgctgatgtggtaataaattaatacgcatgaaactcctatgaaactaaagttataaccactctcacatgcacataaataaacacacatattggatccatagccacactgtaggttatttacaagcattggagtaacaatgtgcatcgatctagagcacagttttctcattgcatcgatcactcgatcatcacccgtggcatttcctaatagtggctactccaatatactattatgtataacaactactaccgtgtgattgaggtgaggaatcttgctgccccacacaaaagccaatccctaccgtctcttggctggagttgacggtacacggaagccaatgccaataatgtcaatgcagcgccactcccacgcatcatcagaactacaacgcgctagttatgtttgcgccaatgatttcattggcgtacgtgcttattatcctgtggttagggcctatttagttgcctgattttggacaaccaaaatcactatgccagcactgtagcatattgtagcgtttcgtttatatttgtgaattattgtccaaatattgactaattaggctcaaaagattcgtcttgcaaaatacaacaaaactgtgcaattagtttttgatttcgtctacattcagtactccatgcatgtactgtaagtttgatgtgatggggaatcttcttttttacatagtgtcaaagttaggattttagggtaactaaacaatgccttagttgatgacaaactggcttcagaattactacacattggatccattactaagatgcatgttatccagatgtatataaatatcatttcaaccaataaaagttgagatgcagacatgcatatatagtggtctctagaagaagaatatatgtatatgtatgacagtagaaggtgtcaatgtatacagacatgtcaatagaacctgatgaccaaggtgtgatgagttccctttcgattgattagtatttgcagagatgggatgatgcttccattcaatgtaaacgcctaatgaatataaacggcaatctaaagcaacttctatatatcctacaagtgtttagaatagttaacaataagctactagctagctcgtggaagccatgaacacaggttagcttgctgccggacttttgggtctccccaattagcctccacactaacgtggagacctgtaaacaaacattagtttatgcgcagccaaccgacgatcgatgatggattggaaaagaataatgtgaatgtgtatgtaaactaagtaagatggtgtgtatgcaggccacaatcattgttaatcactgttgctttggttcggtttggttcacatgacgattaagcaaatgcacatggccatccgtgaataatctccgttgtatgctgcaaggaagagatagagcagtaaggacattgccattttatctgcaatacgcaggtaccgggtcgacggcaagaacagggtagttgagtgagtccctccctcccaacagctaccttggcttggggttgctgcgactgcgagcgcggtcaaaagaattgccgcgtcccccgtctgtccggccaccaaccccggccgtcaaccatgcctgcatgatctgtcagtcactacagtactattattccagcaggcgtaggctctgacgacacgaccgccaccttccatgcatcccggcgacttctctgctccactccattccatccatccatccatctatataagctagccaggccacccggtgtgcaggagcc

SEQ ID NO: 106 - DNA, 92 bp, Setaria italica
acgagcgcgccgccatccagatccagccgccggaactccgccccctccgccgtcggccccgtcgctccgaccggtcggcttctcccttgctg

SEQ ID NO: 107 - DNA, 13 bp, Setaria italica
aacaactgaccag

SEQ ID NO: 108 - DNA, 73 bp, Setaria italica
gatccagccgccggaactccgccccctccgccgtcggccccgtcgctccgaccggtcggcttctcccttgctg

SEQ ID NO: 109 - DNA, 77 bp, Setaria italica
gtgctcagcagctcaattagcacttagcagagagcacatcttgctaccaagattattggagcaaccgactgccagcc

SEQ ID NO: 110 - DNA, 64 bp, Setaria italica
attccaatcacccatcaatctagcaacatagacattgaaaccgacaaccaacctcttagcaaca

SEQ ID NO: 111 - DNA, 59 bp, Setaria italica
aatcacccatcaatctagcaacatagacattgaaaccgacaaccaacctcttagcaaca

SEQ ID NO: 112 - DNA, 29 bp, Setaria italica
caacccatactcaccagtagtaactcgca

SEQ ID NO: 113 - DNA, 41 bp, Setaria italica
cccctcctgcaattcttcctctgaactgtgggtctgcggca

SEQ ID NO: 114 - DNA, 43 bp, Setaria italica
ccaccgagtcggcagctgaacacaagcaacaagcaagtgatcc

SEQ ID NO: 115 - DNA, 72 bp, Setaria italica
ggtctacacgcacccacccaatccatcgtcccagctgcagagcgcgcaagaacactccaaagcagctgagct

SEQ ID NO: 116 - DNA, 202 bp, Setaria italica
cgaaggttaggaataatagtgccgagagcaatcaggcaacacacaccaaccctgctaaactcccgggcctcccagctcataaatagagtatcgctgcgaggccgagcagtgggcgaccctgtgagcttagctagcaagcaatcaagcactgccacctgcaacctcacggagaaagttaaggcggcgagagacagagagatcc

SEQ ID NO: 117 - DNA, 14 bp, Setaria italica
ttctacttccacca

SEQ ID NO: 118 - DNA, 137 bp, Setaria italica
aggagcttgagctttcactttctagcaatgtatttgggcaggaagtgttcgagactgttggaaaatcatgtccgcaactcaggcgcttcagactcagtaaacatggcttctgcagctttgaagctgctgactacaac

SEQ ID NO: 119 - DNA, 45 bp, Setaria italica
ggcttcgcgttggtcgcgcgggatacgactcctacgtcgcgcgca

SEQ ID NO: 120 - DNA, 145 bp, Setaria italica
aaccctaacccctccgtcctccactcctccgccctccgcatcgccacttcgcacgcaggcgccgaacccccaccgcctccttgccggtgcctcctccccctacctcccctcccggcttgcgactcctcccatcggcggctctccg

SEQ ID NO: 121 - DNA, 7 bp, Setaria italica
aacaagc

SEQ ID NO: 122 - DNA, 152 bp, Setaria italica
acgcggtcgtggaccgaacaaacctttccccaaaatttcccctcccctgcaccgaacgaactctcgatccgatcccgatccctgcagggcgccgcctcggctccccgattcggccccggatctgctcgtcgctcggcgggggctctcgattg

SEQ ID NO: 123 - DNA, 20 bp, Setaria italica
tattgatgattaaatgtcaa

SEQ ID NO: 124 - DNA, 46 bp, Setaria italica
cctgacgctctcagcacacccaggaggaggaggaggagcagcagcc

SEQ ID NO: 125 - DNA, 97 bp, Setaria italica
cacagagcttacccactgctgacaggctctgagtgtctaagcttttgtgcgcattggatggccatctatatatacagtatacacatagaaggtccca

SEQ ID NO: 126 - DNA, 31 bp, Setaria italica
atacaacgcaacgcagcagctgagagtcaca

SEQ ID NO: 127 - DNA, 35 bp, Setaria italica
gaaacatctacattctccacacgttgagctaatcc

SEQ ID NO: 128 - DNA, 64 bp, Setaria italica
tcacccccacaaataaataccaatagcaccacattactagattcaggaagcaaaaggcaacacc

SEQ ID NO: 129 - DNA, 69 bp, Setaria italica
cgtggctgcagccgcacaagaggtgatcgagcacgagcagtaactcgagcccgcacgcaccttctctcc

SEQ ID NO: 130 - DNA, 74 bp, Setaria italica
caatcaacactttccttcttccttatttattatagaagtacaattcataattgatctagaaaagaccagaacca

SEQ ID NO: 131 - DNA, 52 bp, Setaria italica
gtgtgtcaaggaaaggatagtgcttgtctccttgtgttcaggaccagaagca

SEQ ID NO: 132 - DNA, 70 bp, Setaria italica
ggtctacacgcacccacccaatccatcgtcccagctgtagagcgcgcaagaactccaaagcagctgagct

SEQ ID NO: 133 - DNA, 31 bp, Setaria italica
cccgcccctgctctggtccgtggccaccacc

SEQ ID NO: 134 - DNA, 34 bp, Setaria italica
catctcaacttagagtcttaggtagtagctcaca

SEQ ID NO: 135 - DNA, 85 bp, Setaria italica
cgttgatatctcttgcagcgttgggtctctgtcacacacacaggaagcacaggaagctaagctagcagtcgcgagagagcgagcg

SEQ ID NO: 136 - DNA, 86 bp, Setaria italica
agatttgcagcgcacactgagcgagtacttggcaggccgatcagctcgttgatagcaagctcactcgtcagtaagtagcaatcagg

SEQ ID NO: 137 - DNA, 30 bp, Setaria italica
gacaaatttgagaggtgcacacaaagaaca

SEQ ID NO: 138 - DNA, 70 bp, Setaria italica
caacatctcaagcttcctctcgctctttgcataaaagttcttgaggttacaagaggccagattcctgaag

SEQ ID NO: 139 - DNA, 208 bp, Setaria italica
gggccgcgagcaaagtcaactgctcgacacctcctcggccaacgtgcctatatattctcggctagccgcgtccgtactcatccaacccaactccaagcacctcatcagattcctcgcctccgtctccgaccacccaccagtcaggtaactagctagagaggaagagatcaccggccggcgatcgattattaacgcgtcaggagaagcg

SEQ ID NO: 140 - DNA, 51 bp, Setaria italica
caacgttttgtgacaaacgtaacacacagagtgacggagagacaaactaca

SEQ ID NO: 141 - DNA, 64 bp, Setaria italica
cggaacacatagactacaactagaacgatacagcctgtgtgtgtgtgagagagagagagagaga

SEQ ID NO: 142 - DNA, 64 bp, Setaria italica
cggaacacatagactacaactagaacgatacagcctgcgtgtgggtgagagagagagagagaga

SEQ ID NO: 143 - DNA, 50 bp, Setaria italica
ccaacgataaggccataactgataagctaacaaagcggaaacatcgtgcc

SEQ ID NO: 144 - DNA, 28 bp, Setaria italica
acaaaacaacagataggattgaacaaca

SEQ ID NO: 145 - DNA, 68 bp, Setaria italica
agctgtgcacaaagcaagcgcgctcatagcctgagccctgagctgagcaagctaaggtactgatcggc

SEQ ID NO: 146 - DNA, 71 bp, Setaria italica
gcaagtcagcagcagcaagcaaacacacagcgttcgtgagctcttccgagcttgcattggtgtaagcaagg

SEQ ID NO: 147 - DNA, 41 bp, Setaria italica
atcgcaaacacttgaaaaggattgtagtagtgctactagtc

SEQ ID NO: 148 - DNA, 60 bp, Setaria italica
ccgccacagccatctagctccactccagtcatctagcttcgcttcgcttcccaccacgcc

SEQ ID NO: 149 - DNA, 28 bp, Setaria italica
gcaaacacaagcgcgtgcgaggggaagg

SEQ ID NO: 150 - DNA, 45 bp, Setaria italica
cgcgcgctcccgccgcacacaccagaccctccttcctcatcagag

SEQ ID NO: 151 - DNA, 62 bp, Setaria italica
tcaccaaatttatctcactaacacctccatttttattgtgtgcaagatagtactcgaatacc

SEQ ID NO: 152 - DNA, 56 bp, Setaria italica
tcaccaaattcatctcactaacacctccatttttattgtgatagtacccgaatacc

SEQ ID NO: 153 - DNA, 61 bp, Setaria italica
atcatcagcttcgatctcactttgagacacaaaagaaagcttgttgtgagattagagcacg

SEQ ID NO: 154 - DNA, 76 bp, Setaria italica
caagcacacagcacaaatcaagaccaattagtgctgtagctagtgtgctttggcatcagctgcctgagctcgagag

SEQ ID NO: 155 - DNA, 78 bp, Setaria italica
aagttacccagcttgcttgcgagtgtgagcagctagctagctagcagagtgatcgagcgttggtgagctgagctggga

SEQ ID NO: 156 - DNA, 79 bp, Setaria italica
ccagagcacagaagctctcttctctacttgtgagtttcagagcactgtgcaagaagatctgttgggtcacttcgctccc

SEQ ID NO: 157 - DNA, 55 bp, Setaria italica
acacgatcggcttgagagcaagaggagaaccagcagagctagctagagctcgatc

SEQ ID NO: 158 - DNA, 78 bp, Setaria italica
cagagcacagaagctctcttctctacttgtgagtttcagagcactgtgcaagaagatctgttgggtcacttcgctccc

SEQ ID NO: 159 - DNA, 76 bp, Setaria italica
tctcatcactctctctccatccgacgccgaggtcgcgacacacctgagcagggagcgcgtgccagtgccaccaccc

SEQ ID NO: 160 - DNA, 63 bp, Setaria italica
gcctcttcttctccttcgtaaatacagtactagtaagcgtatactagcactagctagtaagcc

SEQ ID NO: 161 - DNA, 47 bp, Setaria italica
cgatcaagttaattttgtttctgctttgtgcgcctgtgttccagtaa

SEQ ID NO: 162 - DNA, 67 bp, Setaria italica
cgatcaagttaattttgtttctgctttgtgcgcctgtgttccagtaattactttccgtgtagcaaaa

SEQ ID NO: 163 - DNA, 26 bp, Setaria italica
ctctctctcagcagtatacgctgaca

SEQ ID NO: 164 - DNA, 72 bp, Setaria italica
atcacccatttcattaagacccattagcaactcagaaattgaaaccccactagcagcctcgtagtggcaaca

SEQ ID NO: 165 - DNA, 64 bp, Setaria italica
aagcaatctcaagcgcagagagccaaagctttcggtgtagctcgaagagcaaagcgaaggcaag

SEQ ID NO: 166 - DNA, 122 bp, Setaria italica
cacgcccatttcccgtgtgctctggtgcaagccttttcgtttcgcagggcttcttcctcgtgaaagtctctgctcctgcgctcccagggccgcagaactgaagcacggagagagagggcgag

SEQ ID NO: 167 - DNA, 106 bp, Setaria italica
cacattttggaaagaggagagagagaacgcccagccaaacagccaaggaaacaaaccgcggcgagaggcggaggagagggaggaaggagggcagaggacgagcaag

SEQ ID NO: 168 - DNA, 73 bp, Setaria italica
gatcgcttcgagaggttcgtcgcttgacccgaagggttcgcccccggttgcttgaggcgagtcggggaggaag

SEQ ID NO: 169 - DNA, 127 bp, Setaria italica
cgttgccgcaagactcagatcagattccgatccccagttcttccccaatcaccttgtggtctctcgtgtcgcggttcccagggacgcctccggctcgtcgctcgacagcgatctccgccccagcaag

SEQ ID NO: 170 - DNA, 111 bp, Setaria italica
agatcagattccgatccccagttcttccccaatcaccttgtggtctctcgtgtcgcggttcccagggacgcctccggctcgtcgctcgacagcgatctccgccccagcaag

SEQ ID NO: 171 - DNA, 114 bp, Setaria italica
aacagccccagctagcaacacctgcagcaccaatcaccattagctttgcaattgcagagctcaattcagctgcgcaacgcctagcaacatccgcaagaagaagcagagctagag

SEQ ID NO: 172 - DNA, 396 bp, Setaria italica
gtaaggaagccctacctttctatggttgttttttttatttcattctgttctgcggtggatggatctcctgttcgctgcgaatgagcgctccaatccgaatccttgttgttgctggtatgggtgctccgattcgtctatctcgtggcggatttattcgctgcgcggcggagtagtagttggatcagtttgtttcccagtttttttgttaggattatgaagaaaggtttatggggaacggaaggtttacgtgccacaataaactgcagcaagcagcctcactggaagtggtagcttgcctgcagaatttatttgataggattacctttcacgggctaaataagcagattctgattagtaggagtacccttcttatgcttgaatctgttgatgcaacag

SEQ ID NO: 173 - DNA, 103 bp, Setaria italica
gtgcgtgcccctcatcctcccccttacctgtacacgcctcctcccacttctcgggcgttaatttcaccttccacgctcgctccctctctctctcttcgcttag

SEQ ID NO: 174 - DNA, 552 bp, Setaria italica
gtaccagctttccctcctctctttggttccgcagggtcccgaggttagggtttgcgagggtaggtttcgggcctcgattcgctcgattgaggccggattttgcacggggacgtcggatccgtgcgtgatctgtaggtttcggttcggattgtcgcgatttcgagagtcaattttgcgtgatttttctggtgggcggatgcggacctagggtttcgttaggtcccgaagtgtttgactcctattcgcgaattcgatagggtttcaggccgcgatattcgagcctgttgcctgatttaatcgttgcatgagcaaaaactttgttatgttgctaactcagtaggaatggcaattcatttgagcccttcatttcggcagttgaacatggccattgcatttggtctgtagttacctccataaggttgttcgtggggcttgtatagcttatatcctttgttgttactcccgaattggtgttttccttttagtcttgtgcagtgactgtttgctactgagtgacataattataattaatttcgttctgtatcctctcag

SEQ ID NO: 175 - DNA, 113 bp, Setaria italica
gtaagctcactgcagccagagttcatcaaagtctttccttttccttgtccatgaatcctgaattcctgaccatggagctgagctgatgcctcgacatgaatttgtgagcgaag

SEQ ID NO: 176 - DNA, 501 bp, Setaria italica
cccaggtgaggccccctttctatgccaattctcacacttctgactttttgttcatctcatccttctttgagaattctgtcgaattttggtctatctgtaatgattccagcacacagatagtttatttgagatagcgctgcccttccttctgggtccttgtagtagtagcatcaaaaaaggatattttggagataatcctgaggacgatctttactggatgaaagactgaagcaaaaagctttgagaaactttgttggatgttctgaaaatcttttctttatgagttgatgacacccctgcgttcaaaaccacttgcttaaaaagtggaaaggggcatgatcaaaagatggaaaacaaataccagcatataaaaaagctccagttttgtgaaacaagcatcagggaggataagcatgtgactggccgccgatttacttgcgtagctcacctatttcacagtattcaatttctctgtatttgcccgttgccttgcagtgacac

SEQ ID NO: 177 - DNA, 1003 bp, Setaria italica
gtatagattcagttccttgctccgatcccaatctggttgagatgttgctccgatgcgacttgattatgtcatatatctgcggtttgcaccgatctgaagcctagggtttctcgagcgacccagttatttgcaatttgcgatttgctcgtttgttgcgcagcgtagtttatgtttggagtaatcgaggatttgtatgcggcgtcggcgctacctgcttaatcacgccatgtgacgcggttacttgcagaggctgggttctgttatgtcgtgatctaagaatctagattaggctcagtcgttcttgctgtcgactagtttgttttgatatccatgtagtacaagttacttaaaatttaggtccaatatattttgcatgcttttggcctgttattcttgccaacaagttgtcctggtaaaaagtagatgtgaaagtcacgtattgggacaaattgatggtttagtgctatagttctatagttctgtgatacatctatctgattttttttggtctattggtgcctaacttatctgaaaatcatggaacatgaggctagtttgatcatggtttagttcattgtgattaataatgtatgatttagtagctattttggtgatcgtgtcattttatttgtgaatggaatcattgtatgtaaatgaagctagttcaggggttacgatgtagctggctttgtattctaaaggctgctattattcatccatcgatttcacctatatgtaatccagagcttttgatgtgaaatttgtctgatccttcactaggaaggacagaacattgttaatattttggcacatctgtcttattctcatcctttgtttgaacatgttagcctgttcaaacagatactgttgtaatgtcctagttatataggtacatatgtgttctctattgagtttatggacttttgtgtgtgaagttatatttcattttgctcaaaactcatgtttgcaagctttctgacattattctattgttctgaaacag

SEQ ID NO: 178 - DNA, 1002 bp, Setaria italica
  misc_feature (94)..(94): y= t or c.
gtatagattcagttccttgctccgatcccaatctggttgagatgttgctccgatgcgacttgattatgtcatatatctgcggtttgcaccgatytgaagcctagggtttctcgagcgacccagttatttgcaatttgcgatttgctcgtttgttgcgcagcgtagtttatgtttggagtaatcgaggatttgtatgcggcgtcggcgctacctgcttaatcacgccatgtgacgcggttacttgcagaggctgggttctgttatgtcgtgatctaagaatctagattaggctcagtcgttcttgctgtcgactagtttgttttgatatccatgtagtacaagttacttaaaatttaggtccaatatattttgcatgcttttggcctgttattcttgccaacaagttgtcctggtaaaaagtagatgtgaaagtcacgtattgggacaaattgatggtttagtgctatagttctatagttctgtgatacatctatctgattttttttggtctattggtgcctaacttatctgaaaatcatggaacatgaggctagtttgatcatggtttagttcattgtgattaataatgtatgatttagtagctattttggtgatcgtgtcattttatttgtgaatggaatcattgtatgtaaatgaagctagttcaggggttacgatgtagctggctttgtattctaaaggctgctattattcatccatcgatttcacctatatgtaatccagagcttttgatgtgaaatttgtctgatccttcactaggaaggacagaacattgttaatattttggcacatctgtcttattctcatcctttgtttgaacatgttagcctgttcaaacagatactgttgtaatgtcctagttatataggtacatatgtgttctctattgagtttatggacttttgtgtgtgaagttatatttcattttgctcaaaactcatgtttgcaagctttctgacattattctattgttctgaaaag

SEQ ID NO: 179 - DNA, 102 bp, Setaria italica
ctacaggtattaaaataatactattggcattttctatctctctctcttttttttgctgcattgttttatcattttggttgaatcaatgtataacaggtacct

SEQ ID NO: 180 - DNA, 141 bp, Setaria italica
cctcaggttatttgcttgtactgcattcgcactcctaatgttaaattttgttggatggggcattatatttttcatatgcccaattcatcattcagtgtattgtgttgctaatactttttctgccaaacctttcaggatatc

SEQ ID NO: 181 - DNA, 555 bp, Setaria italica
aagcaggtttgatttctagatccactacatgaaccgtgtactgcttttcattggccatttcaatccttatgaaaatatgaactgaatgcgagctatgtggatttatgggcctgaggatattatgcatttcacagttcaacacaactgttgtgaataatttgggttgagtttaatcaaaactagtgcaatacatcaggaatttgtttatagacaatatgagcaactaaaggtgtggtagatctgaactaacggtgaagacaggtgatagtgcatcatgatcaactaaatgccatttgtaaacttcttaatacatttaagcaaaatttagatcaagtgcctaatgatgagccagaagaataagtgcaagcaactaacaatgcattactctgttgagttaattttcttgatccagttaaggtttgccattgagtggaccctcctttccctccttaatctttttgtgaactcgggccgttcctttcctatttagtagagctatataccagtcttaaatattcgtggtcgcttattctgccttgattgctccaggctctc

SEQ ID NO: 182 - DNA, 104 bp, Setaria italica
atcacggtatctccatcctagcatatttccacttaagtcctttttattttctggagtcatcgtgtatatatattcaaattccatttgcttggctctaggaggac

SEQ ID NO: 183 - DNA, 674 bp, Setaria italica
ccacaggtatattagaatatacaccattcccttcgtgagatctagcctctttcttatgcgagtctgcggctagatggtgcgatccgtgtacggagcaaccgaggagtgaggtttattgttggatcaactccagatctcttaatattgggatatgataaggggcatagatttcgaacataagttattagcgggcgatttgagtccttatttattgctggtttgtaggtatcgatctgatttccggcctgtgtacaagggccatgaactggtggttggtgaaagtcagtttaagatctgtatatagatgttttgtgtgggggtgacagggatctgagttcttggtgacgattaagtcaaagtttaaggtgtggtcttttttctttgaattttttgtggtctaggttcgtgttattggtggtggaaagtcaagaaagggaaatagattctgatgtccgtgacgtttgagggagggggttcccctctttcttgatggtgcaaaatactgatcttgcaattaatgacatattttatattattggtgttgctgtgaggttgcgatttataatttgtttacatgattggtgttatgtgatatggttgatggctatgtatttgtggcctgcagtggttatctgggtatctgatttatcctcgtgatgaatttgcaggtacct

SEQ ID NO: 184 - DNA, 120 bp, Setaria italica
gcccaggttagatatctaacgaaaacaaacctaatttttttgtgtacatgttaatggattgatcatatatcttgtaaattgggattgattgttggtgttgcctttgtgttgtaggatctg

SEQ ID NO: 185 - DNA, 1012 bp, Setaria italica
aagcaggtctgcttctgctccctctgcctccctttactgtgcatggcatgtgaggtttcactgtatgagataatgtgttctagatttgcattgttggacacttggctgagcacataaatgcttttatcacctttttactttgttgaagacaggatttcctttgtttagtagaatatgatatcaaggaaataatttgtagctgctgatatatgaagtcatagattcatagatgctaacctttcttttaaaagacaatcaaggttgcaaggaaaacacagcaagtctgtgacatatatgctgtcagagtcttttatagccaatcaccggcttttgaatcatagtggtgtatactgaagtaatttgcatggcatgacaaattttgcaagacctgaactgtcggaatactattagcaaggtttagtgctattagcaaaaaagaaaaggcttagtgcatataatctgtgctagtttttgttcatgcgtaatcacggaaacggtacctcttactattaagtgtaacaagttctagtagaggcactgtttactttgaagtggcaacaatgtttcatatctcctcattttatgtttcaagttcgtgttcctgtttcatatttcaccccatttgtttattgcattttccatttatattcttaatctgtgaaatctaagatgcttaactgtctttgctgttggttctccactgaaattgacatgtcttgctgcatacatttctactttatattactaaattacaaccaaatggtgaaaattaacttagttatgctattacaaaactgtttattactgacagatggtctagaatacataaggcaccacatatgcataaccagctgtttctaattctaatttgtggaatttgctatgtttgtccaaaactgagacaatctcaattctcaactacattgcatcgaagtacgcttgatgttatgatatttttacttcacattttatttgctggagttgacttggaatttaatgtctgtaggctgtc

SEQ ID NO: 186 - DNA, 105 bp, Setaria italica
accaaggtgagtttcctaattgtctttttaatctatttaaccttcttagttctctttgccatggttctcatctgaccttgttctctccttcaacttcaggaggac

SEQ ID NO: 187 - DNA, 1152 bp, Setaria italica
cgggaggttagggttcccgatttatccagctttcttttttgattgagaaattaatcttgcgtgctgtcaagagtgctgtcctgcttgatctagttgcgtgttgcgtgttcgtggtacgggagatacgggagtgcggcgggagtgcggcgagttttctccgccttttttcttcttctgttttttttcgggtggcgttctgcgatgcggctagatccgctttgtctcgggtgctggtccgtgggtttgttcgagctcgatccacgagatctgaggcttggagcgcacggggggcgtagatccgcctgatttgggaatagtttgatgcgaggactgaatgctgatcacctcccgggtttccgttcccattttggggttagcaaccgtgcctgttatctgttggaggcttggagcggggacacggatggttgaatgtagaatttctggagtgaagtagcttgttcagatatttgatctggatgtacacgtgccttcacggttagtagtgtattaaagggtagctctatctgttgctgctaggtgttggatgtgatttctcgatttatgtactgttcggtgtgtcggattttgggtcatgtttcacctgtttaaggaattatggttgggtaacctgttgatctggggttttgaatgatgatgaattgctgttgaattaaataattcattaatgataaccttgtcaaggatagatccggttggtccttttcagtgatctgtttggcagtagtttaaataggttagttctgtctgattgcttaatttgatggatttggggatcacaacagaatgaacagatcatattacctgcattgtgtggggtctgttattgcgatttttgaacctgaacgtgggtgctgtaagctagtgttcgattagatggtgctgcttggtgtggctgtattgcttttttgagaatggtgtggctttattgctggttcaatcaggtttgtatgaccctttcatatttctcagaaatgttattaataagcttgctcttaccaaacatggaggggcttaatggcttaagtcgagtttagtggccagccatgtacctttaccatgtagtcattttagttgatatcttgtacctttttgaggcaatggcttatcagttcccttttgttgcaggaagtt

SEQ ID NO: 188 - DNA, 122 bp, Setaria italica
tcacaggttgggaaggatgcaatgcaatattatgatgtgcaatcatatctgtataactataatctgaagaaaccaaccagattccttaaccttcctgttcttcttaactatggcaggtatct

SEQ ID NO: 189 - DNA, 163 bp, Setaria italica
cctcaggtttgttcattttttctgttctgataatatgacaactgtctctattcatctagtataggatgacaagttcatttctttgaatgcttagttgcttactgttagtctttacactgttttcttatgaagttttattctgctatgtattgtgtaggacatc

SEQ ID NO: 190 - DNA, 682 bp, Setaria italica
aagcaggttggaatcacatctacttttctactacatacattcgttttactgtgtttagggtgggttgttcgtgcatttgagcttgggcagaaaaaatatatccaaaagtgccttttaactgtaaattttaggatccttgtcctaattgttgagtatatcaggagctttctattgcttctcatacagcaaactaaacacttgtaggttcatgttgcaatttgactactagatatcttgatcactgtgtatcagatcagatagtttctgattagtaatgctacctctgatatgatgatagttctggtaatgctaccactgatatgatgagcttttgatcttccatgtttgcacatatctaaacaggcttgcttgtagtggttttgtgccattctgccctgttattgctagactcttgcttgttattatcctccttgttaaaagaattcttaatgttctactggattgtggtgatacttgtaatatctggcacctacattatcaaggtgataataatgctgtgtgttttacagttttgagtatctaatgccacttaattaatttgtggtaactgggaggcatttgagtcggttgcctgatcatttaactttttaattgtgacttagtccttatgccattgaaactttgataactgataacgattggctaatctttgcaggcgttc

SEQ ID NO: 191 - DNA, 105 bp, Setaria italica
ctcacggtaatttcttctcccaaaataaacctaatctttaatctgttgcctgtctactcttcctatctgttgctaaaaatttgaatttggtatgtgcaggaggac

SEQ ID NO: 192 - DNA, 1370 bp, Setaria italica
caggaggttagggttaccgatttgcctgtcccttctctcgagaaattaatcctgcgtgctgtcctgctgcttgatctcgttgtgcttcgtgttcgtggtacgctagatgcgtgggagtgccgcgaattttattcgatttttttgggggcgatgttctggcatgcggctagatccgctcgtctcgggcgttactgggtgggtttgcttggtctcgatctgcgagatctgaggcggggcgcgtagatccgtccgatttggcagtagtttggtgtgaggaccgaggaccttttgggttccccttctgtggtgagcggcttgtgtatgttggagggagtaaacggaggggatggaatgtggaatttctttagtcgaatgcgttcgtttatctgaatggttagcgtatacctggatatttgatctggatgcaggcgtactctgcaactagggtatctaagggtagtgcggtttgttgcagggaggtgttggggttgaattttctgttgatgaactattatgtgtgggattcgctagggatacaaaacctgttggtctgtgctgaaaatgtggtaggattaaatcattagatatctctgtggttagatctggctggcccatttcagtgatctgttagtctgtgatgtaaatagttcgtgtatgacttggatatgacatggattcttttaggtggtgtttggttggctcaaatgtaacgcaattcgattaccgaatgtaatgaatcacgttacagatgtttggttgtggtggtttgtaatcaattgacgctaattgaatcccttgcctatacaatacctatacaagcttgttacccctcctcccccactgtaattaacacccacgccgtaatctgattacgttactagagtgcaaccaaacaaagagggtaatcacccattccgccaccgaatacactaatctgattccctttgcgtttatgttaccttagcacgaaccaaacactatcttagtctcttgcatcatatcataatgtgttgacggtttgtttgattcaaatggatttggtattgtggaattatattgattattagtttgcttggagtcatatattactattttgaaccgcggattttttgtgctagcaccttgtgttagattagctgatgcctccttgtgtgactgtttgtcactggttgaatcagatttgtgtgaccctatcttgttgcttagaaatgtttagtcacattcttattttagcaaacatgagtgaaatgaatgacttgttgatttttatggccagcatgcacattttctgtatacctgagtaattttgtttagtttctactggcttttggcagcgactttatcagtttattttgttgttacaggaagcc

SEQ ID NO: 193 - DNA, 117 bp, Setaria italica
ccacaggttaggaagggtgcaacgcaatattacaatatgtatttgaatatgtataagctgaagtgtaagcaatcagatttgataaccttcttttctttgacactatcgcaggtatct

SEQ ID NO: 194 - DNA, 142 bp, Setaria italica
cctcaggtatgttcattttgctgctgggatgatagagtggtcactatattttcatgtcataaaagatgcccagttcatttgagtgcctagcgacactcttttcttagcaaactctaatctgctatgtaatgtgtaggatatc

SEQ ID NO: 195 - DNA, 601 bp, Setaria italica
aagcaggttggtatcacatctaccattctgttacatccattttgctctgtttatggtgcagactgtttgtggtgcactggaacctgaactcaagaatggaaccaaaagtacccttttaactgaaaattgtaggttccttattgtccttggctgtttagtataactggaggtcttgattgctcgtcatatgctagaaccttttctctttttcacagttaggttcgtcaactaaaccatcttgaacccaatgtatcagatcagataatttctgattagtaatgttaatttttagttttcatatgatagcttgccctcttagctagctacatactacaattgaatttgcatgcttttagtgattgtgtcattctgtattctgctgtcattgctggactgattatcattggctctgttctgtgggattatgatgagacttgttgtatctggtgctcacattatcaaatgataatgattgtaactacaattcgtttactttgtccaagtaattggctgtcttgtgtgggttaccttaccagttaccagcttaagtctgtcattgcaagataattgatgctgatctactaatcctcttcaggcattc

SEQ ID NO: 196 - DNA, 99 bp, Setaria italica
ctcacggtatttccttcccttccaagcttcatcatttgtcgcttatcgtctgctcaccttgaggtgctaaaaatcttaaattgctctctgcaggaggac

SEQ ID NO: 197 - DNA, 107 bp, Setaria italica
tcacaggttaggaagtgggatgctatgttgtcttgtgtagttgaatccatatagtttgcaattacaacactaactgttcactttctatttttttattaaaggtacct

SEQ ID NO: 198 - DNA, 164 bp, Setaria italica
cctcaggttggtccatgttgtcacttccataacctgcttgcatttgattgttatttctgtgatagtattcttccatcatttccaagtgaccattgtttttcacttgttgactactggactgatatactcttaatgtgacttgccatgcaaatgtataggatatc

SEQ ID NO: 199 - DNA, 522 bp, Setaria italica
aagcaggtaggtattgcatttatctttcgatttgtcgtacaagtttctgagttgttattatcttgtttcatttgtttgaatctagtctggaataaaacatgcaaaattgcacttgttatgtcttccatagttcatcagaacagatggctcatgttggctttagtttgagttggattgtgatgtcctgtttgagtgcaacagttgtgcatcttgtctatggtgacataattacatattgcatgttcggtacagtgcttgttcttcatacgttggtatgataggcatttggcgcttatttgctacgcatactaatctaggaagcagtaaaaaccttgctagcagtagtagtagttctcttcatcatacatttcttaatattgttttttctataatgagctatcgagctagaagaattgcatagtattttcccctgattgagaagactgaattagtagaacagtttattttctaggtgttacaaatgcatgatacaacatgacatactattctttgcaggcattc

SEQ ID NO: 200 - DNA, 127 bp, Setaria italica
ctcacggtatctccgcactgccaaacttgagcttgtctaaatgaatgattgatgcctactcctggagtatggtgctgaggagtataaatctggatgtataatatgaatttctcggtggcaggaggac

SEQ ID NO: 201 - DNA, 818 bp, Setaria italica
cccgaggtacagtccagattcccgtctatcgatagttggaatgtcaccatctagatcaacttgctctgttttttcccctattttcttggtagcttgtagcgcagatgtgcgttatcacttatcaggttggtttaggtagatggtttcctgcccgtatttgtttcagcccccggactctgatttagccgagttgcatgaaggattcataaatattgctggaatctgaatgaatatgactgactggctgactgctccctagatacctgtagcttgtcaaagaaagaaactgaaaaacaattcggcatgtggaattagctgacgtgctacattacacaattctgcagcttttggtgagataggtggctgatcttactgcatggtgattccatttatgttaataccgttttatattttttaggatgatagtggctcaaagtctttttccttactttggatcatttgcaattgttgacagtagggtgcatttcgtttctatggatgctacattcatttatggtaatactgtttaataattttgaggaattcatttgatcacatgtagatttttaggatgatagtggctcaaaatcgttctccttacttttggatcatttgtaattgtcaaagtagagctgcaaaaacatgtgtttgctgctatttgaatgtttaattcatcaatcagtaatttatgcaggctagtattttctgaagagttacaacgtgatgtgtattttgataagaggacaatttcatagttgataaatgccttcaaagctcttttggttcagaggttaactttggttgaactttaggtcacg

SEQ ID NO: 202 - DNA, 84 bp, Setaria italica
ccccaggttagaccctttgaattgctcagttgtctgtttactctttgaaattctagagtctaattttccgtgctgcaggcattc

SEQ ID NO: 203 - DNA, 103 bp, Setaria italica
tagcaggtgtgtatcttctgccttgcttatgtttttgaactttgggtgcatttggtgtaatctaatttgaataaattcttttcattgttttgtgcaggcagac

SEQ ID NO: 204 - DNA, 1166 bp, Setaria italica
cggaaggtgcgaaaatgatctacagttttgcatttacataatatacttcttgaagcatatgtcatatgtgctatgcccagtagcttcaatatttttaaagctcttgtcctgagaactggattgctcaaaactattggaaacaaatctgacaagtgacaagctgcttgtttgtgttgagtgttggttgttgtagctttaacaacaaactgcttaacatatatgagtcttcctctaaagagagctattactcctagatttaaacttgtgagttttagacttggatgcatgaatcaaggacatagatgaaaatgagtttgttaccctacagttattcccttgtaggaaaagatactttatttatttatgacagtgatagcattcattcagcaagggcgtaaggtgtgaaaaagagagagaaaatgtgtctaaaagctttatgacttatatttagagaaaagttgagaagatctaccataaaggcaattggtgggaatagtaacttttagttgattggctgtacaccttccttgtggaagatagaaaacggtactcaatttacattatcctcataatgaacatgttgactagaaaaatgactgtatttgaaatgtagatggataaaatttactcagacctgtgcagtctgggacactagtgcttggttagtttgctgggtttttttccacgtatgatagatcatctgtagctcttctgcaattaagtcatattttggacatagtgagcacatttgtatctgtattactcaatgtgtataggatttccctgataatagatactgggaattgagtaaaattgttttattttttcaaaatacatcaagcatgtattttgttctaaaacatgacctttggtgagtgattaggcatgcatatttatttgaaaccttgtttattgtattatgggcatttgtaggaactgaacctgaagggcattttattttatttagcaccttgctagtttttaagagatgtttttatttatttagtccagagtttctactaatccttaggcttcaagttggtatgtagcattataaatgattgagaatgattactttttacagttgtattgttatatttcctgttaatgcttgatcagctgtcatgacttcatttttactctgtgctaatttgatttaggatctt

SEQ ID NO: 205 - DNA, 111 bp, Setaria italica
ccgcaggtacacgggctgactcctcacatcgccgccgccgccataggcgttgcctggagatcttccccggccacgctctgatgctgttcgccgcgtgttttgcaggcgttc

SEQ ID NO: 206 - DNA, 107 bp, Setaria italica
cgcctggtgagtgaccacgttgctttgcctttggttaactttcactggagtggtcggcgatgttgttgttgctgatgttatagtgctgtggttgcagccaggtggac

SEQ ID NO: 207 - DNA, 1703 bp, Setaria italica
cgcaaggtccgtgaattctggcctcgccaccattttgtacttttgctgctttgattgctttgtgaatgttagcggacgggtggaaaggtgatgttttaagcatcagttagttgcacggaatgtagtcagactactaggtaggcttccacctagtgatggttagggataatgagaataagaatacactttagagtcatcatttagtctgacttgattgctccctagcataggaatgcaggctgtgctgttagttatgaaggatttcctaattgtatgctgtcataattcatagattggatgcatctgcaagcaaatatattctggcttctcgattgctgtattttgctgattggttgtaatgcagttacctttgtatctgtgtttgcaaatggctgtagataaaccatgtaaaagtgaacaattgatgttggttgtttcacttatgaaactggtaaacatgtgtccggatattccaaatgttgccccccataagaaggctgcaggtccatttgttcttatggccttgtcatgcacatattgtctcatgctgttgttcccatgtttgtttcccagttctgttcaccacaaccttatagtgatccttaaattatgaatcagtacagctgactcaggatggcaacggggcggtgcggggccggggggacactccccgtccccaccccgatccctgatctctgatccccgccccgtccctgaaacctcaatcgggggaacagtttgccctgtccccgcccccgttggatccccgcaccccgtcggagccctgtggggatgagcagccagtattacattcgagcaaatcaggcaaaatgtggcagataagttaacaacaagcaaatccatgagataagttcctaacaagattactagaagcttgcatgctgcagctgtgctccacgaggcagcaaaatgccaacacgtacacaacagacaacactctaattcaatgtggcagacttgcacgagaacgacgggaacagcggtagcggcgctggctgttggaatgcctacagctgaccatgaaggcacaaacaatgcttagagaagttggtcagccgcgcacagatgttgaaagcttgcccttcgccagcacggcgacacctccgcgaggaagagacggcgcatccagcgtctggtccttgcggccaggtggcctcgccttgcgttgtgcttgtcgacttgccgctcgtggcctcgtgcctggtgacggcgaaagtgaggtgagaactcaggagcgagatgaatgaatggagagtgctgggtggcggcggtcgtcctctgtgactgattagggttcgcggaaggccggaaggttggagttttatatatgtacgttggtgtattaagctgttgggctgctattttagatgggccacaagcattcgtgggtccccatggtgccccgcggggagaaaatcacccccgcccccgccccgataatgtttcgggtccccgcctcgcttcccccgcgaggggaaatttgtccccgtcactgccctgttcgggtttggtctccgtggggatctggccccgcggggggaattgccatccctacagctgacaatttacaaccacttaggacacgctagctatgatattatggttggtatgaaagatatcttgatgaacatataaaagtgataagtagttaacatggagttaaacttttcatgcaggatctg

SEQ ID NO: 208 - DNA, 159 bp, Setaria italica
cctcaggtgagcagagctccaatccctctcctatcttctcccgtctcgtcgcttcatctggctgttttcttatcttggaactgatgctctgtgtgtgtgattggggatgcttctccggtgtctgatgtatttgcgctcgttgatgcctcgcaggctctc

SEQ ID NO: 209 - DNA, 92 bp, Setaria italica
cgctaggtaagccgccggtatcttcctataatcacttgtgagatttagttgcctgtggtgtgaccttcggtggtgatgctttgcaggcagac

SEQ ID NO: 210 - DNA, 564 bp, Setaria italica
cgcaaggtgaatttcgcttgttttgttgtgctattgtggtgcatagcttgtaatgttcagttactgactatgcttgaataattttaatgggcctagagatcgtgcatgaggttacttgcatcataagtagtagatgtatcattagtaaggaatgcggcactgaatataccatcatcatgcatggcttgaattttgaacagttcagttacagtatatcctttttaatccatcgagtatctgaattgagtgacagatgaagaatcaatgctgtttgtgtaggctatattatcatccagtaattgtttgagtactccttcctagaaatttgcagaatttcttcttggcccgggttatcttttcagtgcttgtgatgttaatacatgttactttagtatttgctttgtgttttgagttgttattccatacgtcgattttggtgccatggcatatagagtggaaacttttggctaagtgatactgtttggtgtgctcctctataattgtatacaggtttccaataattgaacataatttgatcattctttttgcttgacttaggacgtt

SEQ ID NO: 211 - DNA, 142 bp, Setaria italica
caccaggtagcgagccatccgcctgtcctctcctcttctgctgctgatccgctttcaaatccccgttggatttgttccgcggtgttgacatcaccgcctcgcctcatctttgccgcgtttgttttcctgtctacaggtggac

SEQ ID NO: 212 - DNA, 286 bp, Setaria italica
catcaggtacctacccaccaccaatctttgtgcccccgttcttcctctccagttttttcttgttggatcgtccatttgtcacttgatcaccctggatcttcttggatcatgattgaaattattaatattcagtatcacccttgtccgtcacttctgaattccatctgtcgcttctgatagagtgatagttgctgttcagttgccccgttagtcttgcacacaccacatccacttcatctctgacacactgtactcattttgactgcgctctgctttgcaggaagtt

SEQ ID NO: 213 - DNA, 747 bp, Setaria italica
caggaggtacttatgatgatgctgttcttccatccttttccttgagcaaaatgtcgttgctattggattgtgattctcaaactgtggtagaaccttcttagcatgcagttgactattgtgaaatgagactgaccatcttactgcattttgatatccagatacatgctacaaaacatgtacattgtttgaaatttgatcccaaacctttgaactgaatatatgctgtcttctctgtacaaagttttttttagattggttgtgatgttgtgttgtcttctgtgtgcaggctgagaagatcggtcttgattacatggatgttgaagctcttaaaaagatgaacaagaacaagaagcttgtcaagaagcttgccaagaagtaccatgctttcttagcctccgaggctattatcaagcagattcctcgtctccttggtcctggtctcaacaaggcaggtaagtattctgctctgtcaacatctggctgtcatccttcatagttagaaatgagctttatctgttcttaccgcaatctgtgttgtacattcctactattgtagttatatctaatatgtaatggctctggtactgttctgtggaaaggtatttatcagcctcattttgttactatgttttcagtttcatgtgtggcattcccttagcctatacatatacgaagatataacttatttttgtacagcttagctgtatctgcaagattttgaagcttgttggctttttgcaggtccac

SEQ ID NO: 214 - DNA, 104 bp, Setaria italica
tcccaggcgatgagaatgtagtgtctcatatcagaatcgcatttgacttgctggtgttgattatggttatcgatcgttttgttttcatgtcatcacaggcaagt

SEQ ID NO: 215 - DNA, 152 bp, Setaria italica
cagaaggtgagtcatgcatgcttttaaccctaccttgttttaccttttctttctgttgcatcttgtgtgtccactgaatacgtgtcagagcaaacaactgatgttaatccgaagctaactcaggcctgtgattttttgttttgcaggtgagg

SEQ ID NO: 216 - DNA, 440 bp, Setaria italica
cagaaggtgtttattcctgaaatcccattttcgcatctcattcttagctaaattctgattttctgagtcatttagggaggggtattttcctgcaatcgcagttatgatttggtattagcttccatttagttaattacctcctggcgaaacacatgtttctaaaggcagaataagatagctagtggtttaacttttaagttaactatactgatatacatgcaatttgtcattgctgcatcttatatttagttcacattgacaacagactgaaactacaccactcatctgtcttgcattttagcaatctgcacctcatgacgcaaaataattttacttgctatagctgtgcttcactcatggtattcatcccttcaagacaattttttttgggaattgtgctcatttcgaattatatggttcttttcttgttccaggaagtg

SEQ ID NO: 217 - DNA, 536 bp, Setaria italica
caggaggtaggtacctattgcatcctcatccrttccgtctgtctggagcttgttatctgttttcccgttacaattggttaccaaatcgactgtggtggatgccttgccatctccttattgatcaaagaatcgcttatagcattgccatatgcttagcagcttagacgatgcatgtcgtttggtgcttgtcctcttacaagcacaagggccactcgttttctgtcgcactgtagatcataggaaaactaatggaccattgtttggcaaagccatttgctcccaccagaaattgtggctttgcttccaccagaaaatggcattgtctatttcatgagtgttgtcccattggtagcctcagaggttaacttgtcaagaaacaactaaccattgtagtaactgatcatactgatatcatagtaagacattgacaagaaattgttcgtcattgaacatgagctgaacgaaatagattagcttctgtccctttcatcatttgttccagcattcatgaatattgttggttgttgtaggttggg

SEQ ID NO: 218 - DNA, 587 bp, Setaria italica
attcaggtacgggtgctgataaaaaactaatcttccatgtctttactgtaatagaggtcgatcagactgcggatacgcctcttccgcgggggaaatcgagtgtttcttcacttgatttgtgccgttcttggccgtcctgttagcctttccggttggatttgacgcagaggtggagagtagtgttggatcggatttttgggggaactgaagttttgggtgctcttgggaggcatgggaaagtttttttttttatgcgtggtggttggggaagtacggtgatcggctttttagttccataagaatttttcctttttatgcagaccattatctagaacatgtgggtgataaagattctagatttgctattttttttagcgtgagttggattgctagactactacgcttacaagtttttgagtagttggtgaacggtgtataacttgttcacatttgtgtagctgaactgctattgttgcagagcataaaattgttcaccttttagttctgctatagaaatggttttataactggtaaattttatggtgcttttagctgatccagttaagcttacccttttgcaggattgc

SEQ ID NO: 219 - DNA, 101 bp, Setaria italica
cactgggtatgtcatttggctcatcttttttgttgaaccatgcatctacttcctgctgttccaggttctcatgctgtgctgcattcactatacaggaaggc

SEQ ID NO: 220 - DNA, 126 bp, Setaria italica
acagcggtaagtttcacgtcttagcaaaaaattcgaggaacttttgcgatgtcttcttgcgttatttgcgttttttatgctactgattttttttatcattggttttcttgtgttgtgcaggtctgc

SEQ ID NO: 221 - DNA, 3284 bp, Setaria italica
acgctggtaagtgtttctacgtttgagccttttttgtgcactacctggtatctttgggtgcttagatttgatgtgctagatgcgtttaattagctaacttggattagcgaggttgttagcttgtagtttggacttggtgtggtgtggcaagttattttcttgtaaattaattacgttcatgggcttctgtgggctgtagaagctacagcaaggattttttttttatctgtctcgagttcagataaaatttgggcgcaaaattatcccactttgcatgctttccttctcgcagaggatgggggtgctcccatttgaatgttagagattgaattcatttgcatccttgttgtagttaggaaaatgatgattgcctgtagaatggcttgtcttatacaaaccatgcatgagcttattgacttggggacttagacatctttcattacattcttattgagatggtatgataagattggtgttgtcatgtactccctccgttccaaattataggtcgtttggacttttttagattcatatattttgctatgcacttagatatacactacgtgtatatgcatagcacaagctatgtatctagaaaagctaaaacaaactataatttgggacagaggaagtagcaaacacctcccagcagttctttgatgtactaaatttgtgtactgcctagctattaattgaagacttgtggtcaattctttcccaattcgtttaaggattccacatatctccagctgtgatttgcatagtggttttctttcaacatgatttggtgtattgatttgctgcatgctaattaattagaaatttttcagacagaaggcatagctgcctttaagctgagctgagaaattgtatcttggatattattttactgccctcgatggtttccaccaatcagagcgcctttgtcaggggaagaaatatccatgacaacttcctgtttgtccaacaaatggtgaaatccttgcacatgaagagagaggctcatattctcctcaagctggatatttctaaagcattcgactcggtttcatggtcctttctcctggaggttatgaggcagttgggttttggacagagatggcgggacatgttatgtctaatcttgtcgacctcgtccactcgtgtgttagtgaatggggagccaggggaatctattcttcatagccgaggtcttcgttagggtgatccactctctcccatgctcttcatactggtcatggacgtcctaaattctctcatggagtacgcggctagagagagattgcttcagccacttgctgttcagcaagctcggcatcgggtctccttttttgctgatgatgctgtgattttcctaaggcccgggaggactgatctgcaagtaatcagaagcatccttgacctgtttggacacacttccggcctccacactaatctggtgaaaagttctgtttctcccatacactgttcagaggaagagatgcttatcactgctgaagtcttgtcgtgtgctgtaaaggaactcccatgcatgtatcttggtttgcctctttctattcataagcccaccagagaagtgctcttgcctttgattgacaaagtagctgatcatttgcctgggtggaaagcatccctgatgaacagagcaggtcggttggtaatggttaggatggttttatccgccactcccatttattccttgatagctcttgatttgccaaattgggtgtttaaaaccatggataaaaggaggagaggtttcttttggaaaggtcaggacaagccaatgttggtaactgcctagggtcctgggaaagagttcagcggccccgggaaaatggagggatggggaattcataatcctggaactctttggttgggcattggcgtattcgaatgttgggaattcagaaaactgaattcctttccggccttgggctggattccaaattcaagcttcctcattatgccccagcctgtttaaggtagcagtcgaccatattggtggcaaatggtgttttcactcttttctggaaaagataggtggggtaattggtcacactatcgaggagttggctcccaacctgttcaaggccatccccaaaagggcaattagaagacagacagtagcccaagctcttgttaatcgaagctggttggcagacatcaaaggcgcacttacagttcaggttttattggaatatctccagatttgggaccatgttgagggagttgtcctgcagcaagatgttccagatcagctcagatggaaactcacacagaatggcgtatacagcagcaagtcagcctatgctgccttctttgttggaaccattaaatttgctccttggaggaggatttggaagagtttcgccccttcgttgcaaattcttcatttggttagccatcaacaatagatgttggacagcggaccgtcttgccaaacgaggattgcctcaccctgaggtctgtcctttttgtgatcaagaggaggaaaccattcagcatctgttagtcggctgtgtatttacaaggcagatttggaccttgatcctccaacctctacaactgacagccctgataccctcaccttctgaggctcgtttttctttttggtggaggaaggcattgcgctcagtacctaaggagataaggaaagggcttaactcgctaattatcctggtttcctgggagatttggaaacacaggaattcatgtgtttttgagaatgctaggccaagcacctctttgctgctccagacagttggcagatgagtgtagcgtttggggcatggctggggcaactaaacttcaggaactcctagtgaggtcgctggccccaccagcctaggtcaaggggtttttggtcgaggtcatgcttgttgtcgtctgtaagcttcgctgtgtaggtgtgtgggggtgtgtttcagtgctcgggttttggtccttaaccggacttgttgtgctctcttttctctcttaatgaaatgacacacagctctcctgcgtcgttcgagaaaaaaacacatatgtatttggcaattccacactttgaaatcagttcacaccaattgtcggactttaggtaacttattatagagtacggattaccgagtcagctcatacgtgtttgaatgagctaccatttaacttgtatgattgtctagtttgatcctacaacttgtattggttgttttaatttcttcattcccatttgttctcgtgacaggtttttgttggtatatacaagtttatagcctaccttttgtgttgtataggtactg

SEQ ID NO: 222 - DNA, 149 bp, Setaria italica
aaccaggtaagaacttggcccgccgcctcgcagatttgcttccgaatttagcatctcgggttcttgatttcgtatttgttttgcttgctgagatctggggggatcgaggctaattctcggatcttgtttggggtttgttgcaggggtag

SEQ ID NO: 223 - DNA, 1415 bp, Setaria italica
cgcaaggtatatatgcgcttcgatctgggttcgagtactctagtcctgcgattatatctagatgcgcgtggttgtgtggttgaactggctgaagtggtatcctgtcatactatatgatgtcttgatggggataaatgctgttactgttatctctggacggttgacccttgtctctggggatggaatttgtggattggatgctagataactgatgattattcagatggtgggcatcatgtctggggattgaatttgtagatttggatgctagatatttgatgattagtgattgcttagaggaaggtggaaatcatggttgatgagaaacgcgatgcacgtgtgaagggtgccatctggagttagtatgttctgttgaatcttctttgcagagctgcagtttgttatggttaaatttggtttgcttcagtgggggatggtctgtagattgcacccagttcaaattagtagttgaatccgtagagaaaaatggatgttatttttccccttattaaggggaaatctagtttgacatgtacagtgactaactcttggcaaaagctagccaaatataatgtacatgggaactcattctttacacttggttgtcagcaggtctgtaccctcaacagcaattgaggcagtttgccctcaccaataagtttgattttgatcatctatacagtaatctagacaaacgggaagttacttcatgcacagcctgtttgtttaagtccattacaaagagtagcttttggcccatttgtcacccgagtgataaccacgccttgtcctaaacaactatgcttgctcagaatatgcttaacatttttggtagtcaatcttgggcatagtggtaaacatgactttattagggagtttattcatgaagttgaaaaggttagcttggaacaaaaggtaacttgcattcattcctacttctcattggacagggggtggaatttgcctccacattggatatatgacattgcactttgtgattaaaatgttgccatgagtaggatggagatcttatacttacattttataattttctttgggagatctatacctgggttagaatggacaaattgcttcgtacagatatactgatccatttggtgacaagtctaaagctgccaaagcttttcccagtctagttagcttgttgtacactattttagtggttcactgcattcttataaggtgatgataaaatccatgtccttctatgttccctactgtctttttttatattatcgagtctttgatgggttcagtgatatcagcaatgcaatgatgaagttgtccaaaactatttggcatttcccatgctcttaagtagcatcatagttttgtcgggattttgtttcatttatcaaacatggttgataaataaagttatgctgcaggtggtg

SEQ ID NO: 224 - DNA, 93 bp, Setaria italica
cgtgaggtaagttaaaatatctccgcctgtttaactacctttctatgatttacttcataattgactcactgtttcaactcctcttaggtgccg

SEQ ID NO: 225 - DNA, 97 bp, Setaria italica
cgattggtatgttcttccaatcagccgaagtacctctcttttcggttaaatgttagatttgatatttatcagttatctcaattactttcaggtgagc

SEQ ID NO: 226 - DNA, 593 bp, Setaria italica
cgtcaggtattttgagaaactctccatcgtagttacctatttctacctacctatttctacctcaacgtttttttttctggaaaatagtaaaccattttacaatcattgtgtatgtttcagtcaatcgttatgtatatttcaatctatctcgtaatatatcagtctattttggtagccctcttccatagaatcttgttaatagattttgcatgaaagcagtagaatgtaagaccttatagaacaagaggtggatttcacatactctttatttttcttgcaaggatccaacttggttgccatgtggtattaaaaaatatttaaagtatgcatggcctcaatgtttgccaggctagtatgattgacatgagtttatttataatgttctgtgaccacatcagttcttccatgctcatgtttgactttgtgctgtttctatttgaatgctcctgcgcatatctactgaaaagttgcgtttatttgaatttttgtcattgcactcttgcatgcctgttctgtgattttaacaaatgttgaaatattttatcatgttctaagattgtccaaaaatgcttactccatctaatcaggtcaag

SEQ ID NO: 227 - DNA, 171 bp, Setaria italica
tcctcggtgagcggccgcccccgctctctctctctctctctctctctctccccccccccccccccccccctctctctttctaaattctaacaccgtcgatccaatccggcgagctgggaaccaaggggttctgatctgtgggagtctgtctgttttcggtggcaggttctt

SEQ ID NO: 228 - DNA, 765 bp, Setaria italica
cgcaaggtacagatccctgtttcccgcctcagcctatttcgttagattcagtggattttggcgatgtccccttacgagcggtgtgctgagctgtctagcctttagtagaccgtaacgcgagaagttgctggtcgaatacctttttgtgctggttagtctgtggcatgtgctgttgtggtggatatctggtcaatcgtacctattgtgtgtgcttatgcattttcgtgccttttaattgtggcgatagcaggtcctgtggcggttcatagattgcttcctgacccttagttacgcagtactgtgattacataaattattcattctctgaaatgccagcttctactgtgatgttcttttgtccctgctctgcattgaagatcttttagtacactattctaatatctagtaccaactgcttgcatttgtgtgaagttcctgtatatcatattattatgtcgagtttatattccattgtatattggttgcgaaatgtgtaattgccatctaactcctatggtttctttcactgtactttgtttcactttattattgatgtaattcacgtgctaatttaggtgttgactggtcttgttgtggaagtctcttaattatgaatcaaagttattgctttaaatcccatttgcattccttcaatggccctggaaatgccattctttagattttgtggcatcttgatggcttgattgttgcagccaaatgatggtgtttactgtcttactctttccctcttcattgcaggttgtt

SEQ ID NO: 229 - DNA, 98 bp, Setaria italica
cgtgatgtaagtagccagtgtgcaccatgttctgtcttgtttcttccttcctgccatgcaatgtgtttgactgtcttttctttaccctgtaggtgccc

SEQ ID NO: 230 - DNA, 99 bp, Setaria italica
cgattggtatgcttcttccaactcttctagtttcctgaaaatctgttcgtaatgattgcttaagtatctgtacatgttcgatccataatgcaggtcagc

SEQ ID NO: 231 - DNA, 102 bp, Setaria italica
tcccaggttagagctcaatcataatttgtggtctgcttgagctttgtgccaaacaactcttcagatctcttaactccttttctttggtaagcacaggtcacg

SEQ ID NO: 232 - DNA, 137 bp, Setaria italica
ccgccggtgagcatcagcttttttccttgattcagatctcttggtgaaattcgccaactctctacttttttgtttcttctctaatattcctgtgctctgcttcttgctgctgctgttcttgtgtttaccaggactcc

SEQ ID NO: 233 - DNA, 1014 bp, Setaria italica
cgcaaggtacggtaccggtgcatccccctctcgcttgttacgacccataaagaattaatggcaacacaaatctcctattgtttgttgatttagaggtgtcgcggacaaactgctttgatatctattttgttttcccgtactgatttgtgcgctctgaaacttgcggttacttgcggattcagaggcgtcccaagtgtgagacggatccagtagattcacccgcaagacgactttgcagtgtagtagaaagctttgatctttcgatgcgctttgtatagtttcagtcttggtcatgatttgtatctgaattacgtgatctttggggctgcttaggcatctgcggctccccctgttgtggttctggatgtcttcctttgatctgtctagatttttttttttgtttaatgatgaatggttcaaccacaaattaaccctgggctgtcaacaagatacctgtcttgaccgtcaatgaatatgtttcagttacatatttgtaatactgcaaaaaaatccagcaaggttctttggagaaagcggagagttcatatcttttttgcaagaatttaatgctccttgcactgtttattctgcagttctgaacgacatgtttagatctgcaatgctggttaaactaggactatttccctgtaatttgtatggcttctacttgcccagggagttcttttttatcacttttgctcccagcacctccctccgtatagttgctatctgtagccaatgtccttcatgcatgaaatattgtctgaattcattatctgttcctgctggtatgagttgacatgccattcaaatttgtgtcatcagtgtctggattgatacatgttttcatactggaatactggatttcaatatttcttactaccctatgtttgcttgccacaccatattcctttatagtttgtacatccggtggccatattctctctttagatcttgcaatccaacaagtcttgatctgacaataattcctgtatactctttctttaggttgtg

SEQ ID NO: 234 - DNA, 97 bp, Setaria italica
cgcgaggtaagctatcaagtctcacgttctggttcagttacaagtgcacagaatttgtttgaaccttttgtttcccacttgcatcatacaggttcct

SEQ ID NO: 235 - DNA, 101 bp, Setaria italica
cgataggtatgtttgcttccaacctagcctttctttcattcagcaactttggcaatgccttcctgtttataacaagcaaggaggccattttacaggttagc

SEQ ID NO: 236 - DNA, 110 bp, Setaria italica
acccaggtcagtgcgctagctcaaacttggtcaatggcacaacagctttagcctctattgcttccgtgccaactctcttactcactttacgtgcaaccttgcaggtcagc

SEQ ID NO: 237 - DNA, 153 bp, Setaria italica
cgctaggtgagcgccgcgcgcgcccgtcctctcccccgcacgcttcgttgcttgcagaattccgtgatcgtttcatcctgtctcgtttcggtgcgtgattttttgtttccgctgacgggtggtttggattggatctgggcggaccaggtgcgt

SEQ ID NO: 238 - DNA, 115 bp, Setaria italica
ttccaggtgagagcgcgatcccgtcgccggatctccctcgccgcgtggcctggctgtgttcgcgtgctccgaatcctgattgtcggtgccaatttgctgcttgatccaggccaag

SEQ ID NO: 239 - DNA, 669 bp, Setaria italica
cacgaggtacgtgcgccctggcgagatcccgtagcatgttcattgctcgtaggtctgcgggatcgggcctgcttcatgtgttgggtcaaatccatctgatggagggcgtctagatctcatctgagtgataaggccaggaactgagtcggtctagatctacgtgaaagggacatgagttactgataattgtgccagatctctgggaagcaagctttcaggttacttttgcatcatgtgggggccactgtataaagctttagctcgaagctttactcgagcgttgggtacttattgtggatctgattggtaatgtgagtgatcactgaattgagtgagatcaagcagcaaagtgtgcattaatttatagagctcaagctgcatcatggctctagtccagagtatctgttttgtggatctatttgggattttgaaagatcacaaagatccactgtcaatgctttagagatcctgttagaggtactccattttgagcttcataatagtttccgagtcatgtggagtgctgttcgaaaggatccagggctatttacgttagtgtttttcatgcttcatatttaaagtggagaaaccattgagttctagtatccttgttacagatcctgtctttcggacatttatttgaccctgttctgttgtgtccaggtcatc

SEQ ID NO: 240 - DNA, 764 bp, Setaria italica
ctcgtggtaaaataactagttaactatgcattcctaaagacatttggctgtaaatccgcagtggaccttatgactctgcataagcacaaattcaatatcatgttgacatcgctttaagtcttctctttcagagcatcctgaaagttattgatcttggatagtcaatgacacataaagtgtatgtctttatgttgtctctgtgcttgtccttacatgtcctgtgttgttggttgaatggagcttaatattttctgaatttattattgagccttagttgttgtcttgttgacttgtagtactatactcgcaattagaagttgtagttattttcgtcttcttcagaagtccctgaaaatttgaaaatcatgggtagtcaatgacaattgaagtaccatgcatttattttgtcatatattcaatgcttgtacaattgcatgtcctgacttgtctgttgagtgaattaaatttatttttctcttaattggtcattggctattgatttgtaacttactaatggcaactcatatttggagaagcatgtgcattcaagttgattttctgacactgctcgtgttactttcttcatttctgatcacgaaaaatgtgatgatgggacggatcatatactccaataatagtttcatttcctcttggaaaaacagtttaacaaatcattcgtctcagctgttccgttttaagtgtattttcttcctcatgaattgtgcacttacgctgtaaatttgttctcactgttttaggtgtcg

SEQ ID NO: 241 - DNA, 451 bp, Setaria italica
taacaggtgaaattacctgatcctacgtgacttactgacttgtcttatatctgcttcctatagatttgcaaacaagtgtttgtgaaaaataaataatacctatgggttgatacatgttgcaaattagcgtttaggatacaagatttgacaggataattgaaccttttacacaaccattaatgattagatcagtttgaccttagttttttattgcagcaataatttctttatttagttgctaagttcatccttccttagatgaatttcattttctattcccatgctcacttgaacaaccatactaggtcgtacagtattttgaggatagctgaatttgaggttttcgggcaacagtgcaactttaatgaaatgttgcagtcgagagtgaaagaatgttgtgcaatgttttcttccatggactaaagatatagactctgctttgcaggaagct

SEQ ID NO: 242 - DNA, 638 bp, Setaria italica
cttcaggtacgtctccgttccgccgccttgttccgctcgatcctcggtgatgcgctacgcgttggttagattgattttagtcgggggcagagggggattgttggatccttgggtggaggaaagggtatcaccgattatcgctgtttacatgtggatctcgcctcccgccggtagggggaaggggatttcttcgcgtgcgtgctgtttagtgcatatttgttggggatatgttttggcttgtgcgaatcttaggattctcgcgtggaagaacccgatcctctctatgctatgtgatttcacctaggcccgtttggtttaggctcgttcgtgcgccatctgactcccagtttgctggtgccaattttaggattcgatgaattctgtaggttttacattaacctggttgatcctcgccaggaagaaatcagatcctctaaattcctgtgctatgtgatttctatctaggccggtttggtttaggctcattggtgtgttatctgacttctagcttaaatgcgcttaagtatgttaacatcttggaaatgttcgtggcagagattttttattctttgtggtagccgttctacgtcatgctagtctgtgtctacctgacttatctgttcaatgtccaggtctag

SEQ ID NO: 243 - DNA, 95 bp, Setaria italica
tcaacggtgagtatccctaagcggcctaccatgatttcttccttcccgatcctctctttgtcactgatgttcttctcctgctcctgcaggtgtcg

SEQ ID NO: 244 - DNA, 99 bp, Setaria italica
atcgtggtaagcaagcgagcccccaattacctcccgtctcacgctgccgtgccatgtggtgcttgcagtagctaattcttcttcttgctgcagggcacg

SEQ ID NO: 245 - DNA, 1533 bp, Setaria italica
acaaaggttagggctaccttgcctgcccaatcaattctggcctaatttattctagggacgcactcatattaaatcagatgttctttgtaaaattgaaacccaatgctatgcaatgcacagcttgtagcaaacccacacgttattctataccagactgcccggtttaaacggttgttccaacagttccaagtactgccaactcagaaggttccctgagctgaatgataacctcctgccctctcatagcatgataagttatgctgtgcttcttgaacttataaaatcgttgcctcaaaatcctttgattattctaaatcagtaagaattgaggttctggttagagcaactttgaagtttcactggcgctgattagagctagccattcagccaatttttactcccttgcagtctatgtcacactgatgctctgctttgaagtgctctgttctactgcatttgctgtaagaattgaactctttgtgaggaaggcttacaaatatggctggttcagtacatattgtactcaacaaaatttatcttttgctaggtcttgaaatgctttctttggcttccttttttttgtccctactttgcgatctaggacgcatccaccctttaatggcttgggattgatctcatggcaccattcttgtgcatctctgcaaactcatcatgccacatctagttctctttcatggtactgtgaactggtttatttcttgatgcttgagaatttgctccaaaaaaagtgagacgattttgttaccttattaaggttggagattgatttcctgcagaatgagttacattgatccatggattatccggtgtctgaataattggtctatgatatgctgatgaatttcgtgtgctggcatcttagtttcaaggattggttgaactgttctcgtcaaacattatatagtgctaagtgtgtttaacatgattactaatgataccttatacccactgatgagttgatgaattattctgtgcatgttcaagtttcaagtaatttccctcaacgttcctgaagatatcttgtcatcaaactattctactgctatatgtctgttactatatcaaaattttggttcattggacgcccattctatttttctttgcttgcacagtgaccctcatgtttggagtagttcccctcgccccctgaagttctggacaattcactcttagaaatggtcggttcaacacatgtttccatcacaaattatgcctttagaagtctaatttgaaatgcctaaaacaattgtagtaagggtctatgagctgttgatacctgatggttctctcttagattgtgatagtgccttgaccaattatcttgtattattattgatcgattgcataactgttgaaattgaacattaagtagtggcccaattcttcccgtgtacttgcatactgcatgtgcctctctcattattctctatagtttctgctgtgcatgagaatttagcagcatatttgaatgttttagcctcatgagaaacgttattgtacttgcaggaggga

SEQ ID NO: 246 - DNA, 180 bp, Setaria italica
caacaggtaagctatttcctccttgtcctttgaggttcttggttttttcgtcaataactgtttagtactgcatgcacttgttttgagatttattagctagcatgtaccaaactgaagctgaactttgagcgtttgccccattcttgatcactcgacctcttgcgatgtatgcaggagcgt

SEQ ID NO: 247 - DNA, 110 bp, Setaria italica
ttcctggtatgtctctccttcctcccgatcactataattcagttgatgcctgatatcgcgcggcaatcgtttccgtgacatgtgtggaatcggatttggcgcagggtctg

SEQ ID NO: 248 - DNA, 861 bp, Setaria italica
catctggtgagcagcggtttttctttaatttcggtatcctgaaggttgcttttgtcggatttgtgttcgagtttgtgagattcgatgctacgtttaggcgattgggtatttgggtgtgctagagcatcggatatagttctgtgcaagattttactactctatttatttgcttgtagtgaactgtatttatgtgtcaaatctatcatcactcgtcagtgaaaaggtgattacttgaaatttatatgtcagttgggttgcggttacagtcagagtgatgagttcactaaaaataaaaggggaaacttgagctgatagtggtgcatggtgcaatactgcatcttttaaaattggacatgcacagttgattaatcatatattcgttgtgataaattgttttgtagttgtcttggctaatcaaaatccaaagaatctcactcaccagtgaaatggtgattacttgaaatctatctctcactttggttcaataatagtcatggtgatgacccaaaaaatggggaaacttgaactgatagtggtgcatggtgcaagactgcatctttttaaattggatatgcccctttgattaatcatacattcgtcttaataaattgtttagtaattgttaactaataaaaattcaaagccatctctgtaacattctgctcgtggtctttagtttgattagtgtcatctataaaaccttcaaaaatgaaagttttcattataaactaaaaagtatagctgataaaaattctttatgctctggacaattctttgttcctccatgttggtttttaagctttaactaatcagttatctctatttctaatcactgatccaatgttattttttcagggacgt

SEQ ID NO: 249 - DNA, 351 bp, Setaria italica
cttccggtaagtactgctgctgcttgatttccctagtttgttcaattgttggagttcttcatcaattaatttagcttatcacatatatgttatttagtcgacatttgcaactaaaatcttatatgacagtgttgtaatttgtgttctgaatttctgatgttcaacttaattaatatacctcatacagtatgcatgtaagtatttattgtctttgacattaagaagccgcatgtaatgaacttatgcactctaggtcctatgaattgaaaatatatgcattcttttcattacatattttcatgtttgtgctaatgcttaccatgaatccttatttggtgaaaacaggtcctt

SEQ ID NO: 250 - DNA, 1234 bp, Setaria italica
tctcaggtcagctctccttccttcttgctgtggcttcaattctttccagccaacttcttgttgacttaattttactgtaattgctgcacaagattttgcttcgattcgtcttgaccctttttgctatggctaatttctagtgtagtgaacggaacctgttctttagcttgcttatctcagtagtaatcctccatggtagtgacttagtaacgcacgtagtgtgcaattccgagatattgcatcaaaggagtttagaatccatgagaaacttgtataggtaacaatccactatgctatatagctctggcatattaaagttatgcgactttcacaaggctactattgaatatactgctctacagtcagtgaccctaaagaagatggaaaacaagatgatttttgttgttttaattgaaattagtaggtcaaaatatgttacatttcttatttcttgttcaaacagtagcttaaaattccgtgcctttatcttctattttcttcatttgtttccagcatatagcaatttacagttatctgccatcagtacggggattagcagccccctgcttaattcttttttttttatgaaagaaccagatcttaagccagctccctttggcttctaatttgtacagcctttcttgcacctcgagggatttgtccttattgtaataaatatattccattagcatactgtactactttagcatgtgctgcttgttattatgcaaaggcatcctcaaccgcaagtggtagttcatttttgatgcagcacttcattccacagtctcctcagtagtgcttcaaagtttaaaacgcaaaaggcaccattttgagtgtctacccacaaaaaaaaaagttgagtgtcactcactcaacgtaaacagggacatggcaaataagaagagtaaactgcagtcgatcctttgtaattgtgaggattgtacatagaaaactataggaaaattttgctacatcaattaactaacttatagtagtcctgaatagtccatatgggcaattaaacatgtattgttgtgaatttgtactgcagtacttaaaattatttactcctgttttgtatattgattcttaatctctggtactacctctcaaaatatcaaattgtgaaagaacgtatgctatattgctattctgcaagcataaaccacaaaacgactgcaacaatcaagggcactactaatggttctacttgcaaccgcaacaggagggc

SEQ ID NO: 251 - DNA, 516 bp, Setaria italica
caccaggtgagtggaaccccctcttcagtcctcttctcacccactttccatttccagtggttttgttacctactcgcactgaaatgtctccatccaaaatatcagacatgcaaccaccgtctttccattgtgcaacaaatatagtggcatgttctggaaagtctgttctaattctaactaggttctgtatttattctcacctcacctatgtgaaatattttttgtgaccaaactaccggtaatcattcactcaccaaactactaaaatgatgcagacagagtgtggcatgccattgacaggcatgacctataactacattgctctggcctctgaggctctgtgttaatcttatcacaaaggcttgtctcaatccatgtagttggcatgtattaatctaggctgtgtttgggatatgatatcattctggtcctttgctaacgtacatttaatcgcctatcgatgccgaagagttggtataaccttgttcctgttcctatcattgtttgcaggtgatc

SEQ ID NO: 252 - DNA, 105 bp, Setaria italica
caccaggtgagttgctgatttcatttctcattatcgatctactacatatgtatagtagcatactatatcgctagcgactaactaagaccatgcatgcaggtgatc

SEQ ID NO: 253 - DNA, 1339 bp, Setaria italica
ctcccggtgagtacgcacacttatttctcgttgcactcaaagataaattcacagtactgtaccacgcacagtagagtaatcagtgaactgttactgttggttggttactgctagtgcacgcagtaaagggtagtcgatgactaaagactgcagtatactgtagtgtttatgcatacggcccaaggcagaaatataatggatgttagatcatgtaggttacgaagtgttgatgaaggactttgagctgacgtactactagttctttggacttagctcaccaaattattagaacttatgtagcaaactgaatacaaattatttagtatcggagaaaaaactatgcaagtgtaggtccagtgggcgggtcctcttgactttggtgctagagtgcagactgcagaggctaacggtgaaaattagagcgcaaatcatttcagcgcgaggtgtttacagcaacacaaaacctttatgccgtaactcgtaagcgagttgggtagagcagtaaatgaagcgtgtaacataaaagcaacatcctaacaaattaagcccattttttgaacatctagttaaattctgaaattttactgctgctgcctgcttcagcaactatacttttgggaaactgcaccatactagttaccagttcatacagaacatagcaacgaccatatagcaattaaggcaaaaaagctctcaagagactgacaggttaagcattttcaggtcacataatgcacaattagtcatgccatacaagatacgcaatatatcgaatggtcccaaatcctagctgtgcagacctctccaaatcaggcgcatgtgaagatgcatcttcctgcccgatgattgcatgaatttgcactgcatatgccaattaagcagagaggaagattctcttgtgcgtaggcagcagtgtcttcagttgtcgtccctgtcctaatcgctgtcccctacagcgaacttgaggtggctacgtctgccatgattggcacttcttcttgaggataaaatttatcatggataggaacaaggtgcaaaattccaagaggaaattgtggtggggcgatagcctattttgccttcagatttggtaacccatccctttctaggaccacgattttaaaaccctaagctatgttctggggaaaaatataaaaatgtggaactacttgttttgtcagtagctgttctgttgatgtagcggctgaaaagctagaaagactagtactagaatactatttcattttcattatagtatgaaattaaagttactctggggtaactgatcggggagctaaaatataaccgggattttcctttcaccctgtgccaggtgtgg

SEQ ID NO: 254 - DNA, 544 bp, Setaria italica
caccaggtacgtacgcttaccggtgcttgttcagtagcgtcgacaattaaaaaagtcgccgcgacatgcatatgcctggctactttctcatgctcaattgctagttgacaaaacatgaattctctaatgcaaactaaccagcggctcaggataggcctaaagactatttgttaatctatcaccatcaccacacaccattgcatcatttagtacagctgtttagcttatgcatgacatgtacactcattaaccaaaaatatacaacctaatcccttgccacaccctcctaccttacagacacctaaaagatgcccagtatttgtttggaactactaactaacctgttgtcgtacaccttggcttggtcaagcatttaactacgcttcccacaagccataatcaaacaaatctcttgaggataagcaagtaaaagaagtgcttaggatatcttacattatgcaccatggaaagcatcagcggtacggtgtagtttaattagctccaccactcactactgccgatcgtattgtttgtgcaggtgatc

SEQ ID NO: 255 - DNA, 674 bp, Setaria italica
ctcccggtaagtagctctgcactgcggcctctcacctatccagctcgatcatgtttgtggcgcgcagtagtgggataacgatgcttagtttcagatatgaatttgcttctttatttgctgcaaggaaacgagctggtaggaatattcgttcgatcactagacactagtgggggtagtttttcgtgagatggtccctagcattagcacactacgagtagagcagttgtgaggtggcaattcgcaagcgattagcatttgatatgcattctttttctggacaggacatactatagaggtaccaaagaccaatggaagttttcagtgatatgataggtttactgtttgtctccgtttagatatggtgaaccatcgctttaaaggagcagcatgtgaaaaatatatatacagttcattgtcttcttgtaggatgggtttgaacaaactaataacatgtatacacgcttaatttagaatttcaaaaatgtttggaacgtaacagcagtacggaaagaaaattttttttggtcttggcgtactgtatcatgcatggaaataaacataatgctgaattgaaacttggtccgttaactgacggaatttcagaacttttagaaaaaatatacacagtcgtcatataacgttccaaactgtcctgctttgttcatcaggtgctt

SEQ ID NO: 256 - DNA, 625 bp, Setaria italica
caccaggtacgtcctactacactacacctcgtccttctcctgctaattaacaacctaaagcgctaatggcttcgtgtcaaagaaattaagaagtgctaatggcttacagcatggccggtcactatcactaacaggcccaagcttaactaatcaaacaaaattattgcgatgcttctcagccgtaagttcactagtagcagatagaacccaacagattattttaacattaaaatgtatacgaaaggctcaggaaagtcaggataaggctcaatgatcacttagttaaactgatcagcagatgtcaccccaattgattggtatgcagttttcttagtacgatagcctatgtactactcacagagctacaatgacattttcagccacaagattaaaaacccattaagtcaaaacacgcagtctaatctgttcccaacaaccctccgacctaactgaaaaaactttagcctatgtacctaatactagcttgttccatcttactgttgcatatcatttggaatatatgaaatcgcaaccacctgtaaaagtgtgatgaacataatcaattggagttggagtgtcttgcatcgatcgcttacgctgcctgtatatgtggttgcaggtgatc

SEQ ID NO: 257 - DNA, 993 bp, Setaria italica
cgtcaggtacgtcacgtgcagagcgcggcacctcagcaatctttcagccatttctcgcgcatcagctcctttgtgtttctttctctgttgcgcttgcgctatgcatattcccaatttcttatgtgtttatcatggcgatccaatcaggaaaatatatgcacgcagcacgcatcgcataagatgcctagagattggcatgcctagatgacaagaccttaaacgctttattaaactctattatgtgtgaaactaaaggacatgcctttttttgtggagtattaaagcacaatttattccaaagacgttttgagaaaacaaaaaaaatgaacttaaagattggcatgtcaagcgaaaagagttgttaattacctgcagctgtccacatagctacatgaacaaattagttacatgcgtgcaataatactctattattgtatacccctatctagttttctcccatagtttcattattgacccactgtagtagtgtcggtgagcatacacgagcgagtgtgatttccatggcctatgtaccacgaggcacatgcaaaacccggccgctcgctgtttctccgccgggccccctgcacaatgatgtgtcctctccagtcttcactctcaccctatccaggacagtacaaaatctacattgctgattccttgtgccacaccgtaaagaagagacaaagttcatgtggggggcacggcaccgtgctcggtaaagcagcgccaaagtgcatgtagtttcaaagcctcatggcatctcatgtctgccatgggataaagacagggtaaactaaaagggcctctctagctaccatgccatctctactttttagacttgtcaacactgtagtagtagctcaaatgatacgcgaattcttttttactgccaattttaattacattgcgtcccggactgctgcactgaaatcaccatcaagttaactcttgacatttctgatcattggctgcacgaaattacaggccggt

SEQ ID NO: 258 - DNA, 633 bp, Setaria italica
ctccaggttgctactgctttcctagctctttgctactgtatcttattgtttgcatgttttgcactattgtgacgcctgataaacttgtagttcccgaagcgcactatagctaatcagcaacgtttcgtaccataaagttttggcttctgtgtttagtacaatggaactgtacgtgatccgtacaaaattattttgaaatccaaacaaacatatgatgaagcactaaaaattcaatgattattgtgcctatttaccaacttcatctgcataaacacatcacttaaagtgcagtctacaactccaactttttttctatatatgtgcgtaggtattggaaaagtcagcatggaagaatctgcagttcctaggctaacttttcttttaccgtaccagtgataagatagcctacctacatttccaagaggagcacgccactttatttgtaccatggttcatcaatccttcgtttatttaattatctactatgaaaaaaatatgactacacaataattgacagcctccacatgtgtgaaattttgatattccattcaaggcatgtttctaatgactctcatgcgcctaatctaactagtaatcttctctgtcactatctttctctgtgtgcagggatcg

SEQ ID NO: 259 - DNA, 865 bp, Setaria italica
caacaggtacataccttattcggagatacttatatacagtatcactgtttgagtagaatacctgattagaatctggtggctgtagtctttagggaaccatttaagttctacaattggtggcgtgtcatacaagggatagatgaccccctggttactgtacaatcagcttatcatctctgccaatttcagaagctcatgcacttcagtatcatctataggctaaaactagaattcagagatggctattttacacatttttcatgtctgaatctcagttcaaatgttgaactaggttcctctaggcatatgcagaacactattagacttttatccactttgccattcatcatttctagctataatctccagaactagatcaccattaaagatggtagtggtaccatttacaggcccattaattgcatatcaaataccttagtcaacttgtctttctattttcaataattcaatagtttgccaatttttaggctactatagatgatgctaataggcgacttccagttttggatttaattggcatggctacaatatcactaataggctggctgaccaattgagttattagttttgcaacactgaattcacgatcatatatagcctatcaaaagatagcgtaacaatggtttttatgggcattaattgtgtatcaggtacatcttgagtctgaattgtatattccaatgaattatttaccttatgtttgtttagcatagtatttagaaaccgtcagcattacctgcatgcaggacatggtgatagatattgcccacaccaatgtgatattcctttatctaccgattcttactctatttttcatttgttgtctttggtcttgcaggctctc

SEQ ID NO: 260 - DNA, 580 bp, Setaria italica
tctcaggtaagtccattaattcttgttttgctggctatttctacatcacatgattgcctattcatatgtaattgccaccagtgttcctttttaagctcgagccatttaaaaaatattgtatgccctgaccccccatcactggttacacagtgtcatagagctggtacaaggtttctaatgtcatctagctttctcttttcaccagaagtcttgcttttaagatggaaaagttatcacaaatttagaattttggttggtccatgatacctagtcaaatgttcaaaaatcacaaggctctagatgggccttgggaggtgtactgcctgattgccagtatggaacaatatgtgaccattaggcgctaggcgccactcttcgcctagcgcctccaaagttgctaggcagtaggctctggaagtctctgtaatgtactttgtatgatgaacttaacattaaactgtacttagcctgttttactgttttcatttgctgatgaagcctaactgcacatgtctcatactgaaccttattatcattgatctacgaaatgtaactgtgagtgatgtgtttacaggtgtgt

SEQ ID NO: 261 - DNA, 94 bp, Setaria italica
cgagaggtgagctggaagttgtcctgtgatcttgtgcctggacgctaatgcagtcagtctaatgctttgttggtctgatgttaaccagggttag

SEQ ID NO: 262 - DNA, 502 bp, Setaria italica
gcccaggtgaggccccctttctatgccaattctcacacttctgactttttgttcatctcatccttctttgagaattctgtcgaattttggtctatctgtaatgattccagcacacagatagtttatttgagatagcgctgcccttccttctgggtccttgtagtagtagcatcaaaaaaggatattttggagataatcctgaggacgatctttactggatgaaagactgaagcaaaaagctttgagaaactttgttggatgttctgaaaatcttttctttatgagttgatgacacccctgcgttcaaaaccacttgcttaaaaagtggaaaggggcatgatcaaaagatggaaaacaaataccagcatataaaaaagctccagttttgtgaaacaagcatcagggaggataagcatgtgactggccgccgatttacttgcgtagctcacctatttcacagtattcaatttctctgtatttgcccgttgccttgcagtgacac

SEQ ID NO: 263 - DNA, 447 bp, Setaria italica
ttacaggtgtgatatgccgtgcctcaccttgaaccatttcctgaagaaaaggaaatatcctcagaaatttaaaatgctatattgatcaggttattattactcttggagtttggaagcgttatcttggattttggtttattctaggtgcatttacaaactatgtaaactatatttttatgtatttcaataattctagaaagtgacaggtagaactgatccacataaagttggatattgcagggacaggatccatacttaaatattcaatcattctatgctgcagatactgttcatactacacaatcaacatcacttttttaaaaaaaacttagggcaccttacttcaaaaagattggcatgcttgggaaactgtcacatgctcgtattaatacctatcctgtctggggtggagtgaattttaaagttgtttttctgttgcagttggaa

SEQ ID NO: 264 - DNA, 934 bp, Setaria italica
ccgcaggtattatcacaataatctcataccattcctgtatgcatcattttgtcatcatattgcatctatgcagtcaccattttcatgttttttgtggacaataaattgccaatcaataccacccaagaaaaaactgtagtattcagtgtgtaacattaaaaacaaaatgaattcagtggtagttatgagttgtgatttggtgaaactatggatatgaaatagtaccagtgacaaaaaaaaacattcccatgttcttatcagttttattagacgacaaaatctcaatttaaccaatatgattaatcaaatatcttatagtaatttcataagggaagtttagatacgagtcatactttcattctttatataagctacttatctatgttgcttttgtcgagtttctggaagagctccaataaagtataaatttcattgccactacagttgagctacctttgtcagtgagcagacctctttatttgttcttacagtaagatatagcttatctacagaaaaatatccttccgtggccgacattcacctatcattgattggaccaaaagtaattttctcaacagaacttcttgagagttactatattaagtataagcctggatatcatgtgatcccatatatatctaaacagagcaaagatgtgagtgaatatcagtaagaattttatgccctatcacagagaacagtcattcttcttattgtctacataaaggttataggacaagatctaaatctgtatacttgagtctagggtgagtaaacagacttcatttgtattctcaacagtactatttatgtacctagctatagatgtagttgtttcttctcagtctgataacaaaagcttgcaaaggaggtttacctgttattgtaaagtacaagtactctgtactgaaaccatttcttgttgcagatttca

SEQ ID NO: 265 - DNA, 956 bp, Setaria italica
attcaggtaccgatccgtccatttcgccttcgttttcgcttctcgatgccagatctgtggtagatcagggcgtatgtcgggttgatttgtgctggatttagtggatctgagtaggggggggggttatggcatttgaaatctgtagaactgtgcggatctagctgtgtgtgatggtggctgcccagatctgcgattgcttggcataagccgtaggtctggtgaaatggtggctatttgcagttgttattattatagatctgggtatgcagatgtggaatttgaatgggaattagccggaattactcattattttacctggtgttgttgattcagtagatctgttagcttaattgatgctgatttagcttattcttgggtggatctgaacattgttggtctctattttaagaaagtagagtctccggttcgtaacatctgtttagatctagatgcttgttgtgtggaaaaatgtgcttattataatttaacgtagatattgttaaaaattcgaatcattctcagttagaagtgggctagtgacggctgtgttttgctattcaggtttctgcagtgttcatgtacatttgctaaataatgtccttgcaatctgtaattaagcatgatacattaggatgtatgaattcgatgtaatggtttgaaaggcatggcctatgtgttgttattccttgtaagatctagatctgcctgctgtactagagtgtactaggctagttggcttagaatgtgtctatgcctctcatgtacatgtattcctagatcttattgatcagtcataattatattacctagatgttaacttgctcgtacaggcagtcgtgtggtatgcagttatcttattagcttgtttatgatgtgcctttgtgttatctaatctaactgtttccatttgtgatttgcatctctaatgctgcttgttttgctctgttcaggctgat

SEQ ID NO: 266 - DNA, 777 bp, Setaria italica
atccaggtccagtcgccgcccccctctcctcccgtccatcatctcgtcgtcctcgtcgtttaatttccgatttgattcagaggagtcctgcgatttgcagttgcagggcgttagaattctgatttggggtgaactgttttgggggaatttagtcagatctgttggtgctagtaattttagggttcgaaatttgctgcgcgattcaaactgtgattgaggctggaagtaagtagttgctgtcggttttgttgtgcggtacctttgcagcggaagtaagtagttgctcccatcgaatcgaatttttataatttgcagttgtgggtcacgcgttacgcctgctctcgtcaaattgtgcagtgttatttaaatgcttctgtgctctattcgtagtcatcagttttgatcggtttgtgtgtaattgtggatgaattgcgctatttctaaagtttcagttatagtgtactagaagttgattagattagaaaaacgaatatgccttctatcaattcggtggatcccgttcagattctttaaattaagtcatgttcgtaccatttcttagatctgaatgcaaattggactagaggttgtgttcggtgcatgtatctctgagcaactgatatatcgcttattgatgcactgcataatggctaattaaattgatgcatatcataagttgctccacttattgataacatgttgaacccgtgcaattgctcctttgaaccctttataatttgcatcccattaaactgcttttttcccttgcagcctgat

SEQ ID NO: 267 - DNA, 165 bp, Setaria italica
ctggcggtaagtcccatcgatcgatcatctcttcccttctcttgtcgtggactcaaagctcatcgtgtcttgttgtcggatgtacgtgatggcgtgcatcgtgtcattggtgcatgcgtgtgtcatgtgtgtgacgtgcacgtgtgttggcttgtgcaggcgaac

SEQ ID NO: 268 - DNA, 280 bp, Setaria italica
gttcagctgccgttttcgtgtagtctcctatgtgtgggttttttcatggggggagagaagattgcaggttatgtttgtgttctgcagacggtccttatttcggccacttgtatctgtggttgccccagttacctttgtactcctactatttcgtcgccctgtgacagtgaggtcacctcgtggaacttatggttggcttgatcggttgaaactgttatagctgatagttctataagtttttttgtgggtagaggattatgtggatttttaaaatttatta

SEQ ID NO: 269 - DNA, 396 bp, Setaria italica
gccctggattcaccgtctttctgctttattggggctgttcttttgtcgagtccttgccatgtaagctactgtgtttgagatttctggggttccattgagctatattgccggatttgttggttgggtcaaaaccatgtaccttttagactctgttcagtggctgctatattcaaccagtgctgaatcatacattgtgtgttcaagtatcgctttgatggcaaatttggtgccaatgttaaagagtattgaactatctactagcatgttctgtaatagtttttgaatgactcattatcatttctcttgtacattcattctggttatgacctagcggtggtgtcgcccagttagtgttgcccagttaattcatgatttctgatgtaggtaaaaaaaaaa

SEQ ID NO: 270 - DNA, 435 bp, Setaria italica
ggcgccctttgagaagaagcttttggtctgctgcgcttatcatgttttgtggcttctgtgttgtgattcttgatctgccccttgctatcatttgtattgtactgtcctaataagtggtacttgtgagggtattactgtgtctggttatttacctagaggaggaattattgtctgctatttctggttttgctgtttatgtaatggtgaaccaaagaatgaagctgcaggctactttgagaaggaaggggacctgctgctttctatcttgtcatgcgtgattacttgaacagtcctgatgatctattaatgttctttggtcagtgcaagtgtttggtgtagctccaacaggtagtgtttatgtttggtgaagcagcaatggccgactgtatgtgtttggtgaagctgcaacctgcttgtgctaactgaacatgcaga

SEQ ID NO: 271 - DNA, 372 bp, Setaria italica
tgaggtgaatactgttaatatggtctcgggtggctgagttgtacttcctgagacaacatcgtcgacaatcatgacttccttgttttgttttcaccttgagtcatttggtcaattgtttgttcccaacctggtgttgaacaacagcgcattgcaagatggtaagaagagcaatctacttcttaccatcagaacagatgatcgtggcgtgagcatgaatatgtagaaaataaacgctcatacttgaaaggcttttcgttttgtatgtgataactgtgtaaattctgtttgtggaactagcagggatacatatttgggttcttaaataaaattggtcccgggtagactacgggtttcgcctctagtaaaaaaaaa

SEQ ID NO: 272 - DNA, 377 bp, Setaria italica
tacgcgctgctagtagccaagtacctacctcgagggcacactgtaggcagtgtgccatattacaggttcagattggccgggacaaagagtacactgcgattttactatcctcggtatgctggtactacaggttcacattcacatggttactacctggcctgtggtatgctggtactacaggtgttgctctgaatagctcaggcttgacccaagtaagagcagtgcaaattcccaatttccagaaaacaggaggacctccaaaggacttcaatgtaattttaatttctttcagaggtccttttgcaaggggctggatgtaaagtacttttataataatccaagccattgtgcttctcaaaaaaaggaaaagaaaaaaa

SEQ ID NO: 273 - DNA, 336 bp, Setaria italica
ctgtggatattacgtcgatctcaacatttgtgttgtgtgtatctgtgcatacacctgtatgtgcgtatggtcaagatgtactacgtatataatgtagatagtggggtttttttcgattttaccatggctgtttcttttcagttttatatatatgtacttgcattataattcccactcaatttgtatccaaagagtaatattcatacagtccacaagtaaaaagagctgtgaagtcactcgccgaatttgtaattaatcattgtaactcccctccgcacacgcacaaaattgttgtaacagctgtcgtatttgtttttacgcacaatctgaaacgaa

SEQ ID NO: 274 - DNA, 315 bp, Setaria italica
gaaccgtccctgcagtggcttttcgtttaattacaaggagggtgccatcaaagaagccatttgtcttgaataatatggaccgtgtatctgctcgtctgtgggttagattagtatttttcttggcacgattatcgcaccctgctcatacctgtgttagtcttcgtgaatttggtggttttgaggcaaagtttcccgtgtacttgtattgtaaaaccgagtggatgtctgcagtgtttcatctgcaactctgaggtgtgttacggctcgtattaatgatctttgggcaagaaaattgtctggaagaccaaaaaaaaa

SEQ ID NO: 275 - DNA, 319 bp, Setaria italica
gacagtagcggccaaccaattaatttggtacgtacaacgcaccacatttactgtatatacaaaaactagccgaattgccagcgtaaattacatgagagatggggttgtgggaagaaggattataagttgtacacttgtaccctgctctagccaagaattatgaggccagagcggcacataggccatgttttgccctcaggatttgcagatagtgaattctgaggggagcactgtttatttcttcctgtatactactagcatgtaactattgttcttagccttcttatggaaatatctgaatgtgtcctttcttttttaa

SEQ ID NO: 276 - DNA, 291 bp, Setaria italica
tgcggcggccggggcctgaaagaagggagcacttgaagtcgtcttttcctgggttccttccttatttctgaggccaaaagaagaagagtttggttttcctaggcgggcatcaagaatcaaggtcttccattgatgtgggcgttgctgctagttttgagttgatttggtagttggggatgcatggggtgtgtgtgtgcagtcggtcatgggtgctcccttgtttcctggatggatggatgttgctccttcaataaacgcaccggccttggttgccgtttctgaaaaaaaaaa

SEQ ID NO: 277 - DNA, 215 bp, Setaria italica
atggccgtccaccacctcctccgccgcggggtctccggcggcttcccgctccacccgctccgcggcctcctcgcctcccagtcccaggtaccggcgactcctcccctcggctcccccattcttcttgtggtcacacatgttcttgattttgccgtctgtttatattcccggcggcgcaggagctcgagctcgggcggcgtccgttgagctcggcg

SEQ ID NO: 278 - DNA, 203 bp, Setaria italica
atggccgtccaccacctcctccgccgcggggtctccggcggcttcccgctccacccgctccgcggcctcctcgcctcccaggtaccggcgactcctcccctcggctcccccattcttcttgtggtcacacatgttcttgattttgccgtctgtttatattcccggcggcgcaggagctcgggcggcgtccgttgagctcggcg

SEQ ID NO: 279 - DNA, 310 bp, Setaria italica
atggccgaccgcctcgccgccgccgccgccaccttccgcgcctcggccgtcgccgccccgtccgcccgccgtggcgcgcgggccagccgcgccttcttacccaactcgtcggcctcgccagctggcgcgcgcgtcggcctccgcgccgcgccatctcggctcccgcaggtccgtaccctttcgcctctgttgggtctcagctctcgagggcggcttcaaacgcagatcgaaatggtgcggcagacccggctgttgttgacacgtgtgtactttacgtgtgtgatcgcagaaggcgagggcggtgaggtgc

SEQ ID NO: 280 - DNA, 383 bp, Setaria italica
cgccgcggacagcgcctccgagatggagctccgcctctgccttcgtctccacgcgcgcctcccaccagccacgacgccgcccccgccgcctttcgcggcgcccgcggtgctccccgcgtcccgccgaattcggactggtaaggattgcttcagcgcaatcagtcaccgcttctccgtttgtttgggcgcttcgctccgtcaaaatgccgggccgcgcgcaaccatcgttgagcaaatttcgggagttccgatttgattgttcatagatgcttgctacctacgctgagagaggcccttcgttttgttgctgcttgtggtcaggtgggagctacggggttgctcttcggcggcccacgaggcgttcgaatccggcgattcgcgct

SEQ ID NO: 281 - DNA, 702 bp, Setaria italica
atgatttcgccgccgatgccgacgcatctcctcccgacgcggacgatctcccctcgctcaaatggctgcgcagcgacagcgagcccctctcccccctcgatggctgcgcggccgcggcgactcccttcagggcttcaatctgtgtacgtttcacgggtctcattcccacctaatatgttttttttaacacgacttgaggggatatcgactggatttcatgtcgctgtggatgatattttggtcatatcaaatttctcgtctttgttcagtcaaatatggtcaaactggtggcgaaagcacatttcccttcttttaaaagaatacgtttcaaggaagatttgataaacagaatgaccaaattttcggtggcatactgaagaagagagagtccatcttagcacaaacaaaaaacattaataaaaaattggcactggtagtgaaatttctcaagcttgaattcatgtccggagataagttaatttatgacaggagggagtatacaggcacccagcttgtccatctgttctgctgtatctctgtacttatgaagatttttacaacttcccttacgaatttcctgaggagttgcctttggatctttatttcactaattattctgcctttatttattctccttgcttctaaacaaaacactaacacaagtaatcctgcaggactggcagagggaagttttcactggca

SEQ ID NO: 282 - DNA, 460 bp, Setaria italica
atggcggcttccgctctccatctccgcctcctcccctcgccgccagccggtgtgaagctccagcagcggcgcctccgctcggtaagccccgcggaacaccaactagcgcccccttcttcagttcttctccctcctgcatctcgccgtattcctgtttctccgtctcgtgtgtgcgtgtgtgctttcgtggtgctcgagcatatgcccaacagtgtgtgagcattgcaattaattgtttctttctgatagtattcctttgtttgcaaagtgagcattgtactgcccttgactcattgctgcatttaatgggaactgaatgtgacacgttcaattgctggtttagtttaaggctctaagttgcagcatggacatgctagattctgaggttgtgtttgtgcgtggtgtttgttgcagagaatactgaggcagggtggtctgtctcgtagatattcaaaagtag

SEQ ID NO: 283 - DNA, 1014 bp, Setaria italica
  misc_feature (363)..(363): r= g or a.
  misc_feature (546)..(546): w= a or t.
atggaagcggcggcgattgggtcgcagtccccgctctccttcccctccagcctctggtgcgtaccgccccttccttccttcccccacttctttagtcgctcaggttcctcccagcgatttcctgccaagaacccccggggggccggtgccggttcttgaatacaattggcgcggtggtttgctattacattctgtagttcgccgtggggagacgaggctagccctggctaatttaagctgctcgccagtgtgtgtgcatacagccggcgggtaggtagtcatggggaaagtgcagagccagccagagcggtctccaattcgcggctgcctgcgcgttattcggctggtggtggatggtatgcrcagagggtgcgcgtgaattgaatttcacagtgtcaaaatgtgatcttggacggggttcgcgttattcggctggtggtggatggtacgcgcagagggtgcgcgcgaattgaatttcacagtgtgaaaatgtgatcttggacggggttttcccttgatgggctaccttccttttgcctgcgtgawgaatggggaattgacttttcttgctcgtccatcaatcatgcatgagctaaattatctggagtttggtgaccatgtgatttgcgaaggtcttgcatccaggttgccatttaacatgcttagggaattctacttcatttcttgttcctttttttgtttatatgtatttgtatgtgcctgtgaaagtcatttcttgcttgctattcagtgttcacagtgaactgtcagtttcatgttatgtctacttccgaataaaaggaaaacagttatttttcatgtaatttctgtataatcaataaattagcatgcaattgaatgtcttacattttgctttttcctgtgagaatgttcccccccttgtttaactctgtctggaacatgtttgactatttcagcaaagcaaaagtatcctctggtttaccaatctgcaatgtgaaggtcaagaatcgcaggcttgaggtagtttgccat

SEQ ID NO: 284 - DNA, 225 bp, Setaria italica
atggccgccgcgccgccgctgtccgccgacgccctcagcttcctcccgtccgccgccgcccccgccgccgccgcgccgacgccggtcgtcgccgcggcgtggggcgcggcgagggcggcggggtcggtgagggggaaggcggcgctcaggatggcgagaagaggaagtggcctggctccggtggttgggaggaggccacgccggccgcccctctccgtgcggtgc

SEQ ID NO: 285 - DNA, 168 bp, Setaria italica
atggccgaccgcctcgccgccgccgccgccaccttccgcgcctcggccgtcgccgccccgtccgcccgccgtggcgcgcgggccagccgcgccttcttacccaactcgtcggcctcgccagctggcgcgcgcgtcggcctccgcgccgcgccatctcggctcccgcag

SEQ ID NO: 286 - DNA, 81 bp, Setaria italica
atggccgtccaccacctcctccgccgcggggtctccggcggcttcccgctccacccgctccgcggcctcctcgcctcccag

SEQ ID NO: 287 - DNA, 30 bp, Setaria italica
gagctcgggcggcgtccgttgagctcggcg

SEQ ID NO: 288 - DNA, 21 bp, Setaria italica
aaggcgagggcggtgaggtgc

SEQ ID NO: 289 - DNA, 222 bp, Setaria italica
atggcggagcgcctcgccgcctccctcctccccgccgcctccccctccccgtccgcccgccgcgccacggtcgcggcctcggggtccgccgccgcgtccttcccttcctcgtgctccgcccgagcggggctgcgcctccgctcctcccgctcggggtcggcccgcttctccaaggcggctgggcgcggcgggggaggcggcgcgctgcgggtggtccggtgc

SEQ ID NO: 290 - DNA, 228 bp, Setaria italica
atggaatccctagccgccgcctccgtgttctccccctcccgcgtcgccgccccggcggcgggggccctggttcgggcgggggcggtggtgtcggccgggatgaggaggaggagcggcaggagcggcggcatgaggtgccgcgccgtgacgccgctggcgagcgcggtgatgagcaggggcgccgtggcggcgaaggcggcggaggaggagaagaggcggttcttcgag

SEQ ID NO: 291 - DNA, 135 bp, Setaria italica
atggcgtcgttgcacctgactgggccgcgggtggcggtggccgcgaagccggccgcgctgggcgggctccgcctgccgacgccgtcgattgccgtgccgacggggcggagggcccgggggctcgtggtgagggcc

SEQ ID NO: 292 - DNA, 126 bp, Setaria italica
atgggggcactacccgtcgcccacaagctcgctctcacctcccccttcctcccgcgccaccgccgaccctgccccgccgcccaccaccacgggcagcgccggcggcgacatggagtggtggtggcg

SEQ ID NO: 293 - DNA, 306 bp, Setaria italica
atggaggtgtgctgctgctcgacctcgtcgtcgtcgtccgtcctcaccgtgggccacggcggcgccgcgcggatgctggcggcgccggcgggtcggtggggcgcggcggcggggttcgggagggcgatggtgctggcgcaccagctcccgctcccgcacccgctcccgcgccgggcgtcgtcctcgaggccgtccccgcggcgggcgcggaggggcctgatcatggcggtgttcgagcgcttcacggagcgggccgtcaaggcggtcgtgctgtcgcagcgggaggcccgggggctcggggaggcc

SEQ ID NO: 294 - DNA, 137 bp, Setaria italica
cgccgcggacagcgcctccgagatggagctccgcctctgccttcgtctccacgcgcgcctcccaccagccacgacgccgcccccgccgcctttcgcggcgcccgcggtgctccccgcgtcccgccgaattcggactg

SEQ ID NO: 295 - DNA, 62 bp, Setaria italica
gtgggagctacggggttgctcttcggcggcccacgaggcgttcgaatccggcgattcgcgct

SEQ ID NO: 296 - DNA, 126 bp, Setaria italica
atggcgccggcgctgagcgggaccctgggcgcgtcgtcggtggcggcgctgcggccctgcgcggagaggagggcgccgtccgccgcgagctcggtcgctccgcgggggagcggggcggtgaggtgc

SEQ ID NO: 297 - DNA, 143 bp, Setaria italica
atgatttcgccgccgatgccgacgcatctcctcccgacgcggacgatctcccctcgctcaaatggctgcgcagcgacagcgagcccctctcccccctcgatggctgcgcggccgcggcgactcccttcagggcttcaatctgt

SEQ ID NO: 298 - DNA, 28 bp, Setaria italica
gactggcagagggaagttttcactggca

SEQ ID NO: 299 - DNA, 81 bp, Setaria italica
atggcggcttccgctctccatctccgcctcctcccctcgccgccagccggtgtgaagctccagcagcggcgcctccgctcg

SEQ ID NO: 300 - DNA, 46 bp, Setaria italica
agaatactgaggcagggtggtctgtctcgtagatattcaaaagtag

SEQ ID NO: 301 - DNA, 201 bp, Setaria italica
atgcagatgcagcagaccctcacgctgcggggcgtcccctccgcccgccgcgccgcgccgccgccggccagctccgcccacctcgggtcctctccctgcctgctgcgggtcccccgctcgctccgacgacggaggccccgctccctcagggcctccgcctcgctcgagcaggaggtcaaggaagtcgccgcctccccggct

SEQ ID NO: 302 - DNA, 162 bp, Setaria italica
atgcctccgactacgatggcttggacctccctcttcctccccaccaccgccggcgccaccgccgcggccaccggtagccgccacccctccttcagccaccgatcccactgccgcgttcccatgacgcgcctccgtcgcgcgccccggctcgtcgtttccgct

SEQ ID NO: 303 - DNA, 156 bp, Setaria italica
atggcacggtatcttctcgctcccaccaccaccgcctcctcctcctctgccctcctccccaaggatgccgccaagaacttgccgccgtcgcggaccctccgcctccgcgcgctcggctccaggtccggcaaggcgcgccccatcatggcggtagcg

SEQ ID NO: 304 - DNA, 225 bp, Setaria italica
atggcgtcaactgttgccttcagctcagttagcgcgcaggctgggctgatccaaaagccaaggaaccatggtgtcacaagccactatggtttaaaggcatcatcatcatctgttagctttggatttgagtcgtcattcctgggcaggaatgcatccctccgtgcctctgtcgctccaaggattgtgccgaaggcgacgtctgggtctcagatatctccccaggca

SEQ ID NO: 305 - DNA, 56 bp, Setaria italica
atggaagcggcggcgattgggtcgcagtccccgctctccttcccctccagcctctg

SEQ ID NO: 306 - DNA, 76 bp, Setaria italica
caaagcaaaagtatcctctggtttaccaatctgcaatgtgaaggtcaagaatcgcaggcttgaggtagtttgccat

SEQ ID NO: 307 - DNA, 174 bp, Setaria italica
atgctcccaatggccgtccaccccgccaccacgccggccctcgccccgcgcgctcgcgtcgccccgcccagaccttccacctccttggccgccgcctcgtcctcctcctgctctcgcatcgtcggtgtcaagaccaggaggctgccccttcgctcgctccgcagcgtcgccgcc

SEQ ID NO: 308 - DNA, 135 bp, Setaria italica
atggcccccaccgcgatggccgccacctccgtcgctccattccaggggctcaagtccaccgccggactccccgtcagccgccgctccaccagctccggcttcggcaacgtcagcaacggcgggaggatcaggtgc

SEQ ID NO: 309 - DNA, 138 bp, Setaria italica
atggcgcccaccgtgatggccgccgccacctccgtcgctccattccaggggctcaagtccaccgccagactccccgtcagccgccgctccagcagctccggcttcggcaacgtcagcaacggcggaaggatcaggtgc

SEQ ID NO: 310 - DNA, 135 bp, Setaria italica
atggcgcccaccgtgatggcctcctcggccacctccgtggctccattccaggggctcaagtccaccgccggactccccgtcagccgccgcatcagtagcaccggcttcgtcagcaacggcggaaggatcaggtgc

SEQ ID NO: 311 - DNA, 135 bp, Setaria italica
atggcgcccaccgtgatggcctcgtcggccacctcagttgctccattccaggggctcaagtccaccgccggactccccgtgagccgccgctccatcagcaccggcttcgtcagcaacggcggaaggatcaggtgc

SEQ ID NO: 312 - DNA, 222 bp, Setaria italica
atggcggccatggcgtccagggccgccgcggccaccgcgtcgctcgacctcgccgccgcgccggccctctcgcgccgctgccaccgcccgacctcggcgcgcccatccgccgccgccgccgccgcccgcggactgcggatgcgcggggcggcgcgggtggtggtggcggccgcggcggcggcggcggcaccggcgaaggccggcgcggaggaggtcgtgctg

SEQ ID NO: 313 - DNA, 132 bp, Setaria italica
atggaggccgtcctacgacatccatcgctgtcccgcctcaagcctccgaacccgaaccctcacaggacgccaccgccatccctcgcctccccttctctcctccgcctccgcgagcgccggctcaccgtcgcc

SEQ ID NO: 314 - DNA, 282 bp, Setaria italica
atggcggccgccgccaccgccgcagccgcctcggcctccttccccgcggccgccgccctctgccgcgacggccgccggccctcccgcgtgagcgccgcggcgacgacgcccgcggaggcggcggcgctcgctgccgtcccggcgccgatggtgcgggtggtgccggagtcgctgcagcgggagagcgggtgcctcgtggcggggttccgggagcgaggcgcgggcgcggcggatggggatgggttcggggacgcggcgcctgggggaggaggagggcccggc

SEQ ID NO: 315 - DNA, 201 bp, Setaria italica
atgtcggaggccgaccgggtacgcctccgcgcggcggcgctggcgctgcaggacgatggggtaagggacaagccagacgccaaggcgaacgtcttcgcggatcttggctcgccggtgtcgccgctccgaccgcgggcgagcgtggcgacgtcgtcgtcctcgtcgtccgggtcggccaagtcgccggtgccgtcgaatgct

SEQ ID NO: 316 - DNA, 224 bp, Setaria italica
atggcggctctggccacttcccagctcgycaccacccgcgccggcttcggcctcggcgacgcctcctcctccatgttccgccccggcgtccagggcctcaggggctcccgggcctcctccccggcggccacgctcagcgtgcggaccagcgcgcgcgccgcgcccaggcagcagcaccgccgggcgcagcgcggcgccaggttcccctccctcgtcgtctgcgc

SEQ ID NO: 317 - DNA, 121 bp, Setaria italica
gtccgtaccctttcgcctctgttgggtctcagctctcgagggcggcttcaaacgcagatcgaaatggtgcggcagacccggctgttgttgacacgtgtgtactttacgtgtgtgatcgcag

SEQ ID NO: 318 - DNA, 104 bp, Setaria italica
tcccaggtaccggcgactcctcccctcggctcccccattcttcttgtggtcacacatgttcttgattttgccgtctgtttatattcccggcggcgcaggagctc

SEQ ID NO: 319 - DNA, 92 bp, Setaria italica
gtaccggcgactcctcccctcggctcccccattcttcttgtggtcacacatgttcttgattttgccgtctgtttatattcccggcggcgcag

SEQ ID NO: 320 - DNA, 184 bp, Setaria italica
gtaaggattgcttcagcgcaatcagtcaccgcttctccgtttgtttgggcgcttcgctccgtcaaaatgccgggccgcgcgcaaccatcgttgagcaaatttcgggagttccgatttgattgttcatagatgcttgctacctacgctgagagaggcccttcgttttgttgctgcttgtggtcag

SEQ ID NO: 321 - DNA, 531 bp, Setaria italica
gtacgtttcacgggtctcattcccacctaatatgttttttttaacacgacttgaggggatatcgactggatttcatgtcgctgtggatgatattttggtcatatcaaatttctcgtctttgttcagtcaaatatggtcaaactggtggcgaaagcacatttcccttcttttaaaagaatacgtttcaaggaagatttgataaacagaatgaccaaattttcggtggcatactgaagaagagagagtccatcttagcacaaacaaaaaacattaataaaaaattggcactggtagtgaaatttctcaagcttgaattcatgtccggagataagttaatttatgacaggagggagtatacaggcacccagcttgtccatctgttctgctgtatctctgtacttatgaagatttttacaacttcccttacgaatttcctgaggagttgcctttggatctttatttcactaattattctgcctttatttattctccttgcttctaaacaaaacactaacacaagtaatcctgcag

SEQ ID NO: 322 - DNA, 333 bp, Setaria italica
gtaagccccgcggaacaccaactagcgcccccttcttcagttcttctccctcctgcatctcgccgtattcctgtttctccgtctcgtgtgtgcgtgtgtgctttcgtggtgctcgagcatatgcccaacagtgtgtgagcattgcaattaattgtttctttctgatagtattcctttgtttgcaaagtgagcattgtactgcccttgactcattgctgcatttaatgggaactgaatgtgacacgttcaattgctggtttagtttaaggctctaagttgcagcatggacatgctagattctgaggttgtgtttgtgcgtggtgtttgttgcag

SEQ ID NO: 323 - DNA, 882 bp, Setaria italica
  misc_feature (307)..(307): r= g or a.
  misc_feature (490)..(490): w= a or t.
gtgcgtaccgccccttccttccttcccccacttctttagtcgctcaggttcctcccagcgatttcctgccaagaacccccggggggccggtgccggttcttgaatacaattggcgcggtggtttgctattacattctgtagttcgccgtggggagacgaggctagccctggctaatttaagctgctcgccagtgtgtgtgcatacagccggcgggtaggtagtcatggggaaagtgcagagccagccagagcggtctccaattcgcggctgcctgcgcgttattcggctggtggtggatggtatgcrcagagggtgcgcgtgaattgaatttcacagtgtcaaaatgtgatcttggacggggttcgcgttattcggctggtggtggatggtacgcgcagagggtgcgcgcgaattgaatttcacagtgtgaaaatgtgatcttggacggggttttcccttgatgggctaccttccttttgcctgcgtgawgaatggggaattgacttttcttgctcgtccatcaatcatgcatgagctaaattatctggagtttggtgaccatgtgatttgcgaaggtcttgcatccaggttgccatttaacatgcttagggaattctacttcatttcttgttcctttttttgtttatatgtatttgtatgtgcctgtgaaagtcatttcttgcttgctattcagtgttcacagtgaactgtcagtttcatgttatgtctacttccgaataaaaggaaaacagttatttttcatgtaatttctgtataatcaataaattagcatgcaattgaatgtcttacattttgctttttcctgtgagaatgttcccccccttgtttaactctgtctggaacatgtttgactatttcag

SEQ ID NO: 324 - protein, 75 aa, Setaria italica
MAAAPPLSADALSFLPSAAAPAAAAPTPVVAAAWGAARAAGSVRGKAALRMARRGSGLAPVVGRRPRRPPLSVRC

SEQ ID NO: 325 - protein, 37 aa, Setaria italica
MAVHHLLRRGVSGGFPLHPLRGLLASQELGRRPLSSA

SEQ ID NO: 326 - protein, 63 aa, Setaria italica
MADRLAAAAATFRASAVAAPSARRGARASRAFLPNSSASPAGARVGLRAAPSRLPQKARAVRC

SEQ ID NO: 327 - protein, 74 aa, Setaria italica
MAERLAASLLPAASPSPSARRATVAASGSAAASFPSSCSARAGLRLRSSRSGSARFSKAAGRGGGGGALRVVRC

SEQ ID NO: 328 - protein, 76 aa, Setaria italica
MESLAAASVFSPSRVAAPAAGALVRAGAVVSAGMRRRSGRSGGMRCRAVTPLASAVMSRGAVAAKAAEEEKRRFFE

SEQ ID NO: 329 - protein, 45 aa, Setaria italica
MASLHLTGPRVAVAAKPAALGGLRLPTPSIAVPTGRRARGLVVRA

SEQ ID NO: 330 - protein, 42 aa, Setaria italica
MGALPVAHKLALTSPFLPRHRRPCPAAHHHGQRRRRHGVVVA

SEQ ID NO: 331 - protein, 102 aa, Setaria italica
MEVCCCSTSSSSSVLTVGHGGAARMLAAPAGRWGAAAGFGRAMVLAHQLPLPHPLPRRASSSRPSPRRARRGLIMAVFERFTERAVKAVVLSQREARGLGEA

SEQ ID NO: 332 - protein, 59 aa, Setaria italica
MELRLCLRLHARLPPATTPPPPPFAAPAVLPASRRIRTGGSYGVALRRPTRRSNPAIRA

SEQ ID NO: 333 - protein, 42 aa, Setaria italica
MAPALSGTLGASSVAALRPCAERRAPSAASSVAPRGSGAVRC

SEQ ID NO: 334 - protein, 57 aa, Setaria italica
MISPPMPTHLLPTRTISPRSNGCAATASPSPPSMAARPRRLPSGLQSVTGRGKFSLA

SEQ ID NO: 335 - protein, 44 aa, Setaria italica
MAASALHLRLLPSPPAGVKLQQRRLRSRILRQGGLSRRYSKVVC

SEQ ID NO: 336 - protein, 67 aa, Setaria italica
MQMQQTLTLRGVPSARRAAPPPASSAHLGSSPCLLRVPRSLRRRRPRSLRASASLEQEVKEVAASPA

SEQ ID NO: 337 - protein, 54 aa, Setaria italica
MPPTTMAWTSLFLPTTAGATAAATGSRHPSFSHRSHCRVPMTRLRRAPRLVVSA

SEQ ID NO: 338 - protein, 52 aa, Setaria italica
MARYLLAPTTTASSSSALLPKDAAKNLPPSRTLRLRALGSRSGKARPIMAVA

SEQ ID NO: 339 - protein, 75 aa, Setaria italica
MASTVAFSSVSAQAGLIQKPRNHGVTSHYGLKASSSSVSFGFESSFLGRNASLRASVAPRIVPKATSGSQISPQA

SEQ ID NO: 340 - protein, 44 aa, Setaria italica
MEAAAIGSQSPLSFPSSLCKAKVSSGLPICNVKVKNRRLEVVCH

SEQ ID NO: 341 - protein, 58 aa, Setaria italica
MLPMAVHPATTPALAPRARVAPPRPSTSLAAASSSSCSRIVGVKTRRLPLRSLRSVAA

SEQ ID NO: 342 - protein, 45 aa, Setaria italica
MAPTAMAATSVAPFQGLKSTAGLPVSRRSTSSGFGNVSNGGRIRC

SEQ ID NO: 343 - protein, 46 aa, Setaria italica
MAPTVMAAATSVAPFQGLKSTARLPVSRRSSSSGFGNVSNGGRIRC

SEQ ID NO: 344 - protein, 45 aa, Setaria italica
MAPTVMASSATSVAPFQGLKSTAGLPVSRRISSTGFVSNGGRIRC

SEQ ID NO: 345 - protein, 45 aa, Setaria italica
MAPTVMASSATSVAPFQGLKSTAGLPVSRRSISTGFVSNGGRIRC

SEQ ID NO: 346 - protein, 74 aa, Setaria italica
MAAMASRAAAATASLDLAAAPALSRRCHRPTSARPSAAAAAARGLRMRGAARVVVAAAAAAAAPAKAGAEEVVL

SEQ ID NO: 347 - protein, 44 aa, Setaria italica
MEAVLRHPSLSRLKPPNPNPHRTPPPSLASPSLLRLRERRLTVA

SEQ ID NO: 348 - protein, 94 aa, Setaria italica
MAAAATAAAASASFPAAAALCRDGRRPSRVSAAATTPAEAAALAAVPAPMVRVVPESLQRESGCLVAGFRERGAGAADGDGFGDAAPGGGGGPG

SEQ ID NO: 349 - protein, 67 aa, Setaria italica
MSEADRVRLRAAALALQDDGVRDKPDAKANVFADLGSPVSPLRPRASVATSSSSSSGSAKSPVPSNA

SEQ ID NO: 350 - protein, 75 aa, Setaria italica
  unsure (1)..(75): unsure at all Xaa locations
MAALATSQLXTTRAGFGLGDASSSMFRPGVQGLRGSRASSPAATLSVRTSARAAPRQQHRRAQRGARFPSLVVCA

SEQ ID NO: 351 - DNA, 537 bp, Setaria italica
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaag

SEQ ID NO: 352 - DNA, 1438 bp, Setaria italica
cctcttcctttatttttgccatcagcgtcgttgttgaactctcgtgcctgttaaagatgtgtgtgttccgctctttccaaatttcccatataatgagtagagtgagactttgcatagccttgcgcggtaagtccagtattgtagttatagaagtccatcattccaatgcattggatgagggttgccatgcagttggtctgatgcttggctgcgctaaccatgttgccgttaaatcccatatcctccttgtgttcctgcacttagcctagatgtggtgactagtttccatggtttgtctgcatagggtgcaagtggcgttgtatggccatccacgtttagcctgcctatccacggaccaaactcagttttgtgtaattagccgcaagaagaatttgcattttgccggcgcccacgttttccagacagaagagatttctggtgtttcgatgcagcccaggaactgtgctttatatgccgatgctattgtatacatgacggatcttgttagtttctagaagatagtatcctcttccacttatcgaagctcctgaccatagcccatagggcgaacgatgctagatgctaaatgtgaagtggtgatgctgttgtcgatattgaggtcacagatccagttgttactgatagcatcgtgaactgtcctattttgtcttcttgaaatgtcgaagaggagtggagcaatgtccttaggtgctggccatgtagctagccagaagtccagaagctagcctttttgccatcaccaagagtgataaccatgcaggcaacaaatacttgcatgtctgtctcgtcgcatgggatttctatgttggtccagggtttttccggtgatgcctactcatgccaaagccacctcagacggagggctcgtgcgaatttctcgaggtcagcccctcgtattgcttcagtaggcaggttttcgtccagttgactttacatttaccctcggttagctgttggtctcccgctcagaggaattttttacggatcttgtctaagtcttggagcccctctttaaggaaataataaaagaagaaactacttgtttttgcaatgataacgtacatacagatatttctaaagccatcaagtacctagcttgtctaaataacaagtgtgtcctggaacaagtatcgagtacctgaaagcaacctgctttgaattggaaaggataaaaattcgacaaggaacgaacaaaggaggcacatttcttgccggccagaaactattgggtctttgcatccttgtgaattgataaacgtgctggtgtgtttcaatgatgtccatgagatgggaatacaaagtcaagcacgccttattaccttattgtgtggctctgtctgcagaaagcaaccgggcgcattttcttccgataccgtggttactttcaaattggaagacagagacgtacacacaaggc

SEQ ID NO: 353 - DNA, 322 bp, Setaria italica
atcaattcactctgaaaccaatttccaggcatgggcctcatctattgctagctccaccgactgctaaagtggactagcttccaaactactccatctttcttctgcaaaagtatgtcaaacagcgtatacatcatggaacatattggtaaattaaacttcaccagttccgatcatgcatgcagctgcaggttcccagcctgttgcctgttggcaccttttctgctctaataattttggaatggaaccaacccctatgatatttcttctccatctatatatttcggggttagcttgcatgctatccgacagagactaagttgag

SEQ ID NO: 354 - DNA, 320 bp, Setaria italica
caattcactctgaaaccaatttccaggcatgggcctcatctattgctagctccaccgactgctaaagtggactagcttccaaactactccatctttcttctgcaaaagtatgtcaaacagcgtatacatcatggaacatattggtaaattaaacttcaccagttccgatcatgcatgcagctgcaggttcccagcctgttgcctgttggcaccttttctgctctaataattttggaatggaaccaacccctatgatatttcttctccatctatatatttcggggttagcttgcatgctatccgacagagactaagttgag

SEQ ID NO: 355 - DNA, 1422 bp, Setaria italica
  misc_feature (1026)..(1094): k= g or t; y= t or c.
ctgtgccatacccgagtggccattatataaatgtaaacttgattgacgaaataattcaggcacaagctggaaaaatattatttaaattttttttcgatcaatcagggcatcaggtacaaaagctggacagtgtgatcgaaaaggcaacacctggaatggggtgttcgttcggttgggtgagcgcagcaggcccaaaagccgacccaagcaacatccagcgaagaaccagttggacttggaccgaccgattggcgggcgcgcacgtactgatgctgcggggcccactaggcagatcggacggcgggtgcgtcctccgcgtcgcccatcgtgcggtccaggttgtctcagcatctccagctcattccagcctcaggcggctctttggggggcctctatttattttctctctccttttttcgactcgctctcatttttctccatttctttttctttggtcccggaccacaggtacttccagtggaaggaatataattgtagttttctattgtgtaaatagcattgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccaccgtcttccatgacaaaaaaaaatacttccatgtkggactacaktctaaaaaaagaccagagctgtaacatgatgattaaaaaaaagaagaacatttgagacytctgtttcatgctgaattatmccttgtttttttccattcttgttaccgtggtcaaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcgggg

SEQ ID NO: 356 - DNA, 1420 bp, Setaria italica
ctgtgccatacccgagtggccattatataaatgtaaacttgattgacgaaataattcaggcacaagctggaaaaatattatttaaattttttttcgatcaatcagggcatcaggtacaaaagctggacagtgtgatcgaaaaggcaacacctggaatggggtgttcgttcggttgggtgagcgcagcaggcccaaaagccgacccaagcaacatccagcgaagaaccagttggacttggaccgaccgattggcgggcgcgcacgtactgatgctgcggggcccactaggcagatcggacggcgggtgcgtcctccgcgtcgcccatcgtgcggtccaggttgtctcagcatctccagctcattccagcctcaggcggctctttggggggcctctatttattttctctctccttttttcgactcgctctcatttttctccatttctttttctttggtcccggaccacaggtacttccagtggaaggaatataattgtagttttctattgtgtaaatagcattgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccacgtctccatgacaaaaaaaaaatactccatgttggactacagtctaaaaaaagaacagagctgtaacatgatgattaaaaaaaagaagaacatttgagacctctgtttcatgctgaaattataccttgtttttttccattcttgttaccgtggtcaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcgggg

SEQ ID NO: 357 - DNA, 1422 bp, Setaria italica
  misc_feature (1025)..(1115): k= g or t; y= to or c; w= a or t; m= a or c.
tgtgccatacccgagtggccattatataaatgtaaacttgattgacgaaataattcaggcacaagctggaaaaatattatttaaattttttttcgatcaatcagggcatcaggtacaaaagctggacagtgtgatcgaaaaggcaacacctggaatggggtgttcgttcggttgggtgagcgcagcaggcccaaaagccgacccaagcaacatccagcgaagaaccagttggacttggaccgaccgattggcgggcgcgcacgtactgatgctgcggggcccactaggcagatcggacggcgggtgcgtcctccgcgtcgcccatcgtgcggtccaggttgtctcagcatctccagctcattccagcctcaggcggctctttggggggcctctatttattttctctctccttttttcgactcgctctcatttttctccatttctttttctttggtcccggaccacaggtacttccagtggaaggaatataattgtagttttctattgtgtaaatagcattgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccaccgtcttccatgacaaaaaaaaatacttccatgtkggactacaktctaaaaaaagaccagagctgtaacatgatgattaaaaaaaagaagaacatttgagacytctgtttcatgctgaawttatmccttgtttttttccattcttgttaccgtggtcaaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcgggg

SEQ ID NO: 358 - DNA, 905 bp, Setaria italica
  misc_feature (508)..(598): k= g or t; y= t or c;w= a or t; m= a or c.
attgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccaccgtcttccatgacaaaaaaaaatacttccatgtkggactacaktctaaaaaaagaccagagctgtaacatgatgattaaaaaaaagaagaacatttgagacytctgtttcatgctgaawttatmccttgtttttttccattcttgttaccgtggtcaaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcgggg

SEQ ID NO: 359 - DNA, 901 bp, Setaria italica
ttgtctctgatacacaatagacatgaaataccttggtgccagggttctcactcttctggttatgttgtttgattcttgatccaaactcaagatgctgaactgaaatcataaaatttcatcctttacaaattaccctaaaggagttgttttcattttgccttcaattaaagttcttcgccttcaacggtgtggtttgttggaagttagaagcattggcttcgtggcatggacctacttgcaaataatttcctcccaattaaaagtttttttttgcaaataatgcctcttttgatgccatcgccttttctagcccgtgacaaccggagttcaggagatgcataactgtctttgagatccccttttatttatttttatttgattgcaaactaattttagttggcactagccaggatgggctaaataattcttgagatgttggcctaaataattttcagaaatgaagtgtcctccacgtctccatgacaaaaaaaaaatactccatgttggactacagtctaaaaaaagaacagagctgtaacatgatgattaaaaaaaagaagaacatttgagacctctgtttcatgctgaaattataccttgtttttttccattcttgttaccgtggtcaaaaggaaatgttagatactaactgataactgaaaaatagatgcatatccttaaaaaagatctccatttggaaaaaatatgataaacacgaaattcgtagacgccgaacatctgaaatattattcaattttttgggggaaaaaaatacacgcctcgtatttcaaaccgtatctgtgtcacggaccacgcatcaatcgagtccacgtaccacccatcccttcccctccccttcccccccgctcttgtataaactccaccaccccagtcctcgggg

SEQ ID NO: 360 - DNA, 721 bp, Setaria italica
aaattgattttcaaaatctgaattctaggcaaaatttgaatggacttgtttggattcatggatttcaaaatctgattccatggttgtttctttgatacatgccttttttgcccggcgtccagcgccacgtccgtcggaggatgccaccaggggaagctcggggctggctgaagaaatcgagctccagattggtcgctgtggtgttaagactcccgacagaattgccgaggtcccctcgcgaatccatcgatggccagcagccgcgcctgctgattccgctggatccggcgtcggcggccaagcctcgctccgattaggcgagcggcgactatgggcgggcctggtacagtgaacaagcggggcctgctactggggacgagatgctaggaggcggcgcaaggagcgtgcgcgcgatggggagggatgggaaggaggcggtggcggcgggattctgcgagcgacgcaggaggggacggagcacgggaaagatcgaggctttctgtgcgggaacgggaagaaaggggaagaccggagaatggtagaatcggggccttaaacagagcaacacgagaccttcaatcgacgggagatgcggcggcgttcgccggcacaaaggcacggcggagcctgcgctgtccgccgtgcacgctgtggccgagagacggcttgctgtttctttctgttgttgcgggtgatcgaacaagccacctatttcctgtcc

SEQ ID NO: 361 - DNA, 898 bp, Setaria italica
ctatttgggttataccatcgacatacatgcgcgtgcttgttcaaccccaatagcacaatcaatctatatatgctgaagaaaaggagttcatgggcttgtcggctttcgcttcttaatacatggcacaaatgtcgtaaaaggcccttagctcagagaagggtagtgtattggcccacattatgttcatcattgggccatgaatcgtacgattcacttggctcccccgctccttattcgaaaaagaattgattttgatgcactagtaaggtgattatcattttgatgaaatgattccattgggactccaactaatgcgtactgaccgcagctaatactttgtatgccaatgacatgcaacatgtaacaagtacgttgcttaatttgttattggactccaactaatgcgtactgaccgcagctacatgttggatcaggccatcatctccaatgccaacgcggactccttgaagttaaaaggctatatcgttggattcttcagaaactactcaaggaatgggattgatgtcgaaagattttatagtatataagaattactagtcataggtctaaaaaaattctttttattgtccatctaagcccacttaaaattgtttttgtaaaagtatatgaaagatgcatattcccgggagaatcatcaaagaatagtggcttcatcctctgggttttcttttgttcatccatgattcatagattatttttattgtcctatgaacttgtataccaactacttcgacctcaaccagcaggtcctgtactcattagtcatcgccactgacctctagccgccggatgacctataccctgacgcatcattggcctatcaactgcaatataaattgaggcaccaataagcccacttcactcaacactcaaacta

SEQ ID NO: 362 - DNA, 2352 bp, Setaria italica
cctagctgacactaactttatcgcttggaagacaagcctcagagcataacccttaatttcagtatccagtggttatttatccgtattgtgcattaagtttctaggtgttgattcaaaccttagatgcatgatccctaggtttccttgttgatctactagtatgtgtaggtcattagtactaccatgcttaattaggttttggtagaagtctagtgattttctatcactcgcgagatacaagatcttttgatacttttaacaaaggttacttgagaatgaatcactgaggaaagaaaattagagaccgggcggagatgagtttggttaaggatatgaagtggattgaaagtaaacctctgcctatgttcattaaggcccgaaccgttgttggctgtgctgatcggggattgaacagtactaacgacatgccgggagtaggaggtagtcgaaaccagcaaaccttcgtaccttggtgcgcgctaacaacttgagcttgatcctgacttcagcatcgggtactattctataactcatggctgaccctacggggtatcgacggggactagtgcttgagggtcatggggcaattcaaatgttagcgttcgccaagagaatggttgccatgcgcagctcgacggggcattgcgtgtgttgtgtgattagatttaccttgcaagggataaaatcggatcaattcaccatatctctcggataagagaactttgatcacttggtcacgtgtagtaatggaaatggaatggtgatgacatgagatatgtttatgatattctttgatgattagtgttgtataacatgctagctctggttagttatgcaaacctagttggtacttgctacatattaaacccaagctaaaatattgaaagtaaggatctagtaagcttctttttgcaaaagaaacccaaaaaactagaactgagtcatctaagtatttaccacagtcgagtaaaacttgttgagtattagtatactcagagttgttgttgtgatcctgtttcatgtggtattacattcatgtcatgacacatcggtaggctcattgtgttgtcctctgctcgttgtcgttgatagtttatcttctagcttagctttggcaatggttttcaagtttctttccgctgtgcattttaaagctctgtattatttttatatttgaactctatttgtaaagctaattgttataccttaatttgtatagtgtttgtattatctctgctcaccttcgtgtgtgacttgtggtgtattgtttcgatcgagatatcagtggttgaatcaggcttgaccagacagactgttagattacactgttttaagtgtgtactgaccgaatcaaccattaagaggatggttagcgcactggtttaatctgggctattctaccacagtatgaaactggttaatgattttgtctacgtagattcatccccgtctatctatttgggttataccatcgacatacatgcgcgtgcttgttcaaccccaatagcacaatcaatctatatatgctgaagaaaaggagttcatgggcttgtcggctttcgcttcttaatacatggcacaaatgtcgtaaaaggcccttagctcagagaagggtagtgtattggcccacattatgttcatcattgggccatgaatcgtacgattcacttggctcccccgctccttattcgaaaaagaattgattttgatgcactagtaaggtgattatcattttgatgaaatgattccattgggactccaactaatgcgtactgaccgcagctaatactttgtatgccaatgacatgcaacatgtaacaagtacgttgcttaatttgttattggactccaactaatgcgtactgaccgcagctacatgttggatcaggccatcatctccaatgccaacgcggactccttgaagttaaaaggctatatcgttggattcttcagaaactactcaaggaatgggattgatgtcgaaagattttatagtatataagaattactagtcataggtctaaaaaaattctttttattgtccatctaagcccacttaaaattgtttttgtaaaagtatatgaaagatgcatattcccgggagaatcatcaaagaatagtggcttcatcctctgggttttcttttgttcatccatgattcatagattatttttattgtcctatgaacttgtataccaactacttcgacctcaaccagcaggtcctgtactcattagtcatcgccactgacctctagccgccggatgacctataccctgacgcatcattggcctatcaactgcaatataaattgaggcaccaataagcccacttcactcaacactcaaacta

SEQ ID NO: 363 - DNA, 2348 bp, Setaria italica; identical to SEQ ID NO: 27

SEQ ID NO: 364 - DNA, 1632 bp, Setaria italica
actgcgcgtggcacgaaggttatcaaattaaagcctagcattgcacaatcgccaaggatcgcaaaacaatcctcctcctcatctgaggagctgtagctgtcctcatcgtcgtcctcctcatccgatgagtagtcactgtcgtggtcatcttcctcctcatctgacgagcagtcgctgccatcatcgttgtcatcttcctcttcgtctgatgatgagtagtcactgtcgtcaccatcatcttcctcatccgaagagcagtcgctgatgtcgttgtcgtcataatcttcctcctcatccgacgtgtagtcgtcgctgccatcgtcatcggacgaagacgaagactcagtctccggctcgagtatcccttcgagtttcttcagtacccgttcaatggctgcctgtaagcctgccttctgcctgacccaatcgtcgtctacctcgacatagccctccttggcctccatctctttgcgcacgcacttctgcaacttctgatagccctcctccgtctgacagaacgcgttggccctgaattagaagaggtcaggtagccgtcggcgtcaggccggggttgctcgtctctgctaatattgcagtgcatctaggcaggagtccgaattgaactcagagtcctcgatcgatccggattggcgttaaagcacggattagggtaggtttgcaggttatgtggtctgcagatttcttcctttcagagtttgttacggacttctgagtgcaatatatggccgtgctggggtacggtgttgggtcggatcggactgtgggctgaaattgggagcaggtcgaaccgaaaaaaaatagagaagaaaaggattttgtggggctatagatggctagtgagtagtgactgattcttatgtccttcgaaacttggaggggctcatatacatgttgtggtaaaactagcaaaaaacaaaatggagagagagcgagcgagcgagatgacacaaattgaacaatgcagagtctactcaatgttcttcctcctttgggtcggatttctatgaagcaatgttcatgttttttcacgcgacccggatcctatatttcctttttctcttttttcctaggaattggtgggatttgcccaacttgatcatctcacaatattgacctagaatgtctcttgcagtgtaatgctcatcattggtgcaaagcattctagcaggtgagaaaacatgaacgactcaatgacatccatgaggattggctcatggaacaaatcctatccgagtcagatgaacaatgaagctcaaaatgatttggatccacatcagcaaatcacagctttacaaaccaactttaacaaagtggaacacatatttttgtggctaagactttcacgtgtttaaaggtgaaccgaccatgatgttgtcacaaagacaataccaacagaagaagacacttttttgcttgtacaacggcaagttgtcttgccaacacatacattacaacacaagggtatttatcactaaatgccaaaattgactagataccatgtcatctccagtttatcaagctagcgatttgcaaggcacaagcaaaaatcttgctaaagctacatgagctctcatgcctataaatacgccccaaatgttgtgtaggtattcc

SEQ ID NO: 365 - DNA, 1722 bp, Setaria italica
aggaacaagggagataacttcaaacatgtcatcttttccttctttttttagcaagaacagtaggggaaaccctactgcggtaaagaaagttgtccaaaagggagaggaaaaaattaacgaagggcattaaggcatgctaaggaaaaataaacttctagtagatagttcctttactgagcctgaagtaaaatgtcattggtaaatcctttctgccaagaagagaagctcggtctattgcttttgctactaatacagcttgcattgtactaattaattaaccttgtgatctgtctcccttatcatgatcaccacgtgcacatagtgattagtccatgcccgaatttgtcaaagtcgttacgaaaatctcgaggtcgcctctgcaatgtcaaccactgcaagaggaataagaattgtttgggtgctcagcgtatgcctgtgctgatcttcaaacaagcagttcagacttaatgcaggttgttatttactagcttcactgttagtataatgctagtatctgacaacaaaagataaaccctggggtttaattactatgggcgatctcgttatcttttgattgttgtctcaccagctgtacatgtttcacagtgctggagagaatggtcaaatgcatacagtgtaaggaatgaaatggcatgagcatgcatatttaagcgtattgtcatatgcataaattttgcaggtttttcaaccaaacaatttattccaagagaaagccaagacaaaatctcatgttccaaagggagcacaaaatccttgcgaaagtaagacacttgcttttgttctcaggtcgggtaaaatagagtatgtgttaagagtttggaagtttctagtatatactttacagatctgtatggtctatctttggagctctgctggcgccaagcacttgtgtctgcttggatggccaatggcaggaagcctgctacacgtttagtctctctggtctctcctccttcctatctggttgttgttgtttcttactaggaacaatcttgtgagcctttgatccgtatacgtgcgcccggttggcccgcgttgtaactaaacgttcttcgttatatcttcttaatacaaagatacgcagctctcctgcgtattctcgaaaaaaaaataaagatctgtatggtccttatccaagaaccctataaatgcacagatcaaggagagacacaacatgtaagtaaatttcaagcgatagtttatggaacgggacctagcttcacctattagacaaatcagtctggtgccaaaatcttttgctgatttagtagcagtgacaagtacaaaaaactgaaaaaacttgataaataacttcactattaacacttagaatggagcaagcagctaggtttagtttgaatgggtcttccaaacaccaatgaccatgtcaaatgctaaaactttgtgccatcaataatatatggagatgactttaagaagctagcacttaggagatcatctagagaggagagcatagcgagtactagtgagaagaaaattcgtaaattgtggccacttctcttcttgcatgtactcaatggtcaagtcaagaagctccattaattccattggctttaaaagcctccacttggtctcctatgggaacacactgccgttaacttgcatgatattaagataaagaaccactacgtggcctccagcactataaatacccatgcagccttcacttggaactcatca

SEQ ID NO: 366 - DNA, 1721 bp, Setaria italica
ggaacaagggagataacttcaaacatgtcatcttttccttctttttttagcaagaacagtaggggaaaccctactgcggtaaagaaagttgtccaaaagggagaggaaaaaattaacgaagggcattaaggcatgctaaggaaaaataaacttctagtagatagttcctttactgagcctgaagtaaaatgtcattggtaaatcctttctgccaagaagagaagctcggtctattgcttttgctactaatacagcttgcattgtactaattaattaaccttgtgatctgtctcccttatcatgatcaccacgtgcacatagtgattagtccatgcccgaatttgtcaaagtcgttacgaaaatctcgaggtcgcctctgcaatgtcaaccactgcaagaggaataagaattgtttgggtgctcagcgtatgcctgtgctgatcttcaaacaagcagttcagacttaatgcaggttgttatttactagcttcactgttagtataatgctagtatctgacaacaaaagataaaccctggggtttaattactatgggcgatctcgttatcttttgattgttgtctcaccagctgtacatgtttcacagtgctggagagaatggtcaaatgcatacagtgtaaggaatgaaatggcatgagcatgcatatttaagcgtattgtcatatgcataaattttgcaggtttttcaaccaaacaatttattccaagagaaagccaagacaaaatctcatgttccaaagggagcacaaaatccttgcgaaagtaagacacttgcttttgttctcaggtcgggtaaaatagagtatgtgttaagagtttggaagtttctagtatatactttacagatctgtatggtctatctttggagctctgctggcgccaagcacttgtgtctgcttggatggccaatggcaggaagcctgctacacgtttagtctctctggtctctcctccttcctatctggttgttgttgtttcttactaggaacaatcttgtgagcctttgatccgtatacgtgcgcccggttggcccgcgttgtaactaaacgttcttcgttatatcttcttaatacaaagatacgcagctctcctgcgtattctcgaaaaaaaaataaagatctgtatggtccttatccaagaaccctataaatgcacagatcaaggagagacacaacatgtaagtaaatttcaagcgatagtttatggaacgggacctagcttcacctattagacaaatcagtctggtgccaaaatcttttgctgatttagtagcagtgacaagtacaaaaaactgaaaaaacttgataaataacttcactattaacacttagaatggagcaagcagctaggtttagtttgaatgggtcttccaaacaccaatgaccatgtcaaatgctaaaactttgtgccatcaataatatatggagatgactttaagaagctagcacttaggagatcatctagagaggagagcatagcgagtactagtgagaagaaaattcgtaaattgtggccacttctcttcttgcatgtactcaatggtcaagtcaagaagctccattaattccattggctttaaaagcctccacttggtctcctatgggaacacactgccgttaacttgcatgatattaagataaagaaccactacgtggcctccagcactataaatacccatgcagccttcacttggaactcatca

SEQ ID NO: 367 - DNA, 976 bp, Setaria italica
tctcatgttccaaagggagcacaaaatccttgcgaaagtaagacacttgcttttgttctcaggtcgggtaaaatagagtatgtgttaagagtttggaagtttctagtatatactttacagatctgtatggtctatctttggagctctgctggcgccaagcacttgtgtctgcttggatggccaatggcaggaagcctgctacacgtttagtctctctggtctctcctccttcctatctggttgttgttgtttcttactaggaacaatcttgtgagcctttgatccgtatacgtgcgcccggttggcccgcgttgtaactaaacgttcttcgttatatcttcttaatacaaagatacgcagctctcctgcgtattctcgaaaaaaaataaagatctgtatggtccttatccaagaaccctataaatgcacagatcaaggagagacacaacatgtaagtaaatttcaagcgatagtttatggaacgggacctagcttcacctattagacaaatcagtctggtgccaaaatcttttgctgatttagtagcagtgacaagtacaaaaaactgaaaaaacttgataaataacttcactattaacacttagaatggagcaagcagctaggtttagtttgaatgggtcttccaaacaccaatgaccatgtcaaatgctaaaactttgtgccatcaataatatatggagatgactttaagaagctagcacttaggagatcatctagagaggagagcatagcgagtactagtgagaagaaaattcgtaaattgtggccacttctcttcttgcatgtactcaatggtcaagtcaagaagctccattaattccattggctttaaaagcctccacttggtctcctatgggaacacactgccgttaacttgcatgatattaagataaagaaccactacgtggcctccagcactataaatacccatgcagccttcacttggaactcatca

SEQ ID NO: 368 - DNA, 3010 bp, Setaria italica
actgatatatgcttctgtgtggtatggtcatggacacaatattacatgcttttatttggagtgtttacttaatgggttccatgctatcatatagtctttctatttatatgaagaagtatggtcttaatttctggagtgcttatcctaaagctgtaatttcacatcatcacagaaggatatgcagaatatttcttcttaaattgaaacaacattgattcctagatatgtaacggtcaggttgagtttatggtagtaacttgttggcatggtgatgcagcagaagcatatctttgatcaaaaatattttcttactaggtgtgctctagagctaaattctaaaatctatattgtgaacatcatgtcttctactgagagctcatatcagcccatcagctgccagtgttcgctagaactgtaaagctattatccaatagctctgattgcgttctcttttatctgtgcattctctaggccgtgacaaaatcagaacctccagaaaaggcattaagtagtgatgcacaaccaactcaagttattactgagctccgaaggagctatactagtaaattggaagaggtatgcttctatggaaacataattttttttaatctgtgttaattctgattctttactcaacatgcatttttgcattttctgtgcatctttcagtcagagaagcggaaacaggaattgttagctcaattggccgcagaagaacaacatggtcatgagctcacaaaaatagttagagaactgctacctactcctaagaagactgcaaatctacaaaggcagccgcggcacagaagggtaaacttgcttggttgccgttgtttccagttactacccacggattaaaaatttgatgtgaattttcttccagaggagcaatgatagatcaaaggtgtcaaaacgacttactgaagaggccgagcaatactttgaagatttcctatcaaacgttgaagacaccgacttttcatcttttgatggagaaagaagtgacacaagttcaacaaggaaagatgtgttacatcatgctatgatggaaactccagtggctctcccgaaagttgcttcacctgctgaggcagatggcgttgtccttccttggctgcaatgggaaactgccaatgatcttcaaacctccccatgcaaaaccaaggctgaggtaacgatgacaccattttctatagaagtagtaatatgtttcttattcttaaaatgtagaatattacacattactcttaaatggaaaggatgttttgtgaaatggctgagctaatattttcaacattaatgccaccaacatgttaccttttctctgattgcatggcgaattgatcattttcagggagaaagcatggcatgcagcactagcaatcagactgtgagcagccgtgggagctggagccctggagactactccacttcaactgcctctaaagataaactgctggccaggtttgaggaggtcgggattcgccaaagcagctgccctcattttgctggaacctcgtcatttcacattgacgactatctgcatctgcggcagagtgaggacctcctctttgagaagtggaggcagaagcaaagaatcgagtctggcggcctgttcctgtgcagtagaccgacaatattgtagattatggccaattatttatcggcctggtcctggcaggatgagtgtagtagtgtacctaatttggtaggcaatgggtttgagttaggccaataaatgtgcaggtttacatttggttgccatgttagttcataacttcatacacttccatttttgtacgtcggcgatgtttcaaccagaacagattatgtttccttgggactgtaaatttcttcatcgctccatcccaatgaacttgcaagagattcgtgttagcaaccaaaattgctctgtccttcccaaaaagcattgcctctggatcttttccgatcaagatcagaaaccctatatgtattgttcttatgttctgctgtgggtcgttggttcttgtcacccttaaacttctctgtttggtacccagataaatacaaattcggctggtgggtagaaaaaccgcctacgaacactggtttcaccttataagactactgcactgtttctagcaggcttatttttctcttcgttttttatattccaatgtatacatattaatgtttatcgagctatgatcttataaatttgtacatgcttcaatattttctaaaaacttgaataacagtatgtaaaacctaggttgatgtttcaaatgaacttatttaacattttacgttgaaacagtacatcgcgaatggcatattattttgttgcatttattctaaacaccttaaaatggaatttgaaaacgggctctaagtttgagagaagtttaagggtaatagtattctaaacacttcaagtttgagatccaaaataattaatctctcacctatcacctccaatcaagttgtttatcagtttatgccatgtacatgtatcgctggtttgttatttcacctcattttcgctatgtatctactactattgcgctaatctcaaatattagatgacatgtaaactaaaatctttggaaagattaataggatacccgcgggtgctgatatctgtttctaaaaatgttgaatctaactatttgtaaatattgatatatttttcagaaatgttggatttagtcttgtgaaatgttgaaccgatatctctgatatggatttaatgggcttaaagcttccactagccgtgtgcatgggcgaaaaaaaatcttggccaagtgttactccgtcgcggccacacgccacaagtcctcccggccctcgctcgccccttatcccatcgtacccgccacacggcgcgccaccagtggcgccgcggatgcgcctcatctccccggcggccacctcgcgcggtttagatttccctgggcccccctcgcggtaccgtcacatatttttggcgcctcttcttctgcgcccctctcctcccgaaccgcagata

SEQ ID NO: 369 - DNA, 3016 bp, Setaria italica
actgatatatgcttctgtgtggtatggtcatggacacaatattacatgcttttatttggagtgtttacttaatgggttccatgctatcatatagtctttctatttatatgaagaagtatggtcttaatttctggagtgcttatcctaaagctgtaatttcacatcatcacagaaggatatgcagaatatttcttcttaaattgaaacaacattgattcctagatatgtaacggtcaggttgagtttatggtagtaacttgttggcatggtgatgcagcagaagcatatctttgatcaaaaatattttcttactaggtgtgctctagagctaaattctaaaatctatattgtgaacatcatgtcttctactgagagctcatatcagcccatcagctgccagtgttcgctagaactgtaaagctattatccaatagctctgattgcgttctcttttatctgtgcattctctaggccgtgacaaaatcagaacctccagaaaaggcattaagtagtgatgcacaaccaactcaagttattactgagctccgaaggagctatactagtaaattggaagaggtatgcttctatggaaacataattttttttaatctgtgttaattctgattctttactcaacatgcatttttgcattttctgtgcatctttcagtcagagaagcggaaacaggaattgttagctcaattggccgcagaagaacaacatggtcatgagctcacaaaaatagttagagaactgctacctactcctaagaagactgcaaatctacaaaggcagccgcggcacagaagggtaaacttgcttggttgccgttgtttccagttactacccacggattaaaaatttgatgtgaattttcttccagaggagcaatgatagatcaaaggtgtcaaaacgacttactgaagaggccgagcaatactttgaagatttcctatcaaacgttgaagacaccgacttttcatcttttgatggagaaagaagtgacacaagttcaacaaggaaagatgtgttacatcatgctatgatggaaactccagtggctctcccgaaagttgcttcacctgctgaggcagatggcgttgtccttccttggctgcaatgggaaactgccaatgatcttcaaacctccccatgcaaaaccaaggctgaggtaacgatgacaccattttctatagaagtagtaatatgtttcttattcttaaaatgtagaatattacacattactcttaaatggaaaggatgttttgtgaaatggctgagctaatattttcaacattaatgccaccaacatgttaccttttctctgattgcatggcgaattgatcattttcagggagaaagcatggcatgcagcaactagcaatcagactgtgagcagccgtgggagctggagccctggagactactccacttcaaactgcctctaaagataaaactgctggccaggtttgaggaggtcgggattcgccaaagcagctgcccttcatttttgcgggaaacctcgtcatttcacattgacgactatctgcatctgcggcagagtgaggacctcctctttgagaagtggaggcagaagcaaagaatcgagtctggcggcctgttcctgtgcagtagaccgacaatattgtagattatggccaattatttatcggcctggtcctggcaggatgagtgtagtagtgtacctaatttggtaggcaatgggtttgagttaggccaataaatgtgcaggtttacatttggttgccatgttagttcataacttcatacacttccatttttgtacgtcggcgatgtttcaaccagaacagattatgtttccttgggactgtaaatttcttcatcgctccatcccaatgaacttgcaagagattcgtgttagcaaccaaaattgctctgtccttcccaaaaagcattgcctctggatcttttccgatcaagatcagaaaccctatatgtattgttcttatgttctgctgtgggtcgttggttcttgtcacccttaaacttctctgtttggtacccagataaatacaaattcggctggtgggtagaaaaaccgcctacgaacactggtttcaccttataagactactgcactgtttctagcaggcttatttttctcttcgttttttatattccaatgtatacatattaatgtttatcgagctatgatcttataaatttgtacatgcttcaatattttctaaaaacttgaataacagtatgtaaaacctaggttgatgtttcaaatgaacttatttaacattttacgttgaaacagtacatcgcgaatggcatattattttgttgcatttattctaaacaccttaaaatggaatttgaaaacgggctctaagtttgagagaagtttaagggtaatagtattctaaacacttcaagtttgagatccaaaataattaatctctcacctatcacctccaatcaagttgtttatcagtttatgccatgtacatgtatcgctggtttgttatttcacctcattttcgctatgtatctactactattgcgctaatctcaaatattagatgacatgtaaactaaaatctttggaaagattaataggatacccgcgggtgctgatatctgtttctaaaaatgttgaatctaactatttgtaaatattgatatatttttcagaaatgttggatttagtcttgtgaaatgttgaaccgatatctctgatatggatttaatgggcttaaagcttccactagccgtgtgcatgggcgaaaaaaaatcttggccaagtgttactccgtcgcggccacacgccacaagtcctcccggccctcgctcgccccttatcccatcgtacccgccacacggcgcgccaccagtggcgccgcggatgcgcctcatctccccggcggccacctcgcgcggtttagatttccctgggcccccctcgcggtaccgtcacatatttttggcgcctcttcttctgcgcccctctcctcccgaaccgcagata

SEQ ID NO: 370 - DNA, 888 bp, Setaria italica
ccacatcggtagatcacatccaaggtgctaaatagtgacttcaaacctgcgcttgtacacaatgtccactcatttgctgttaaatcttagtgtcaacttcttactgacgagttttcctggttcattaactttgcttttcaagtaatatgtatttttctactttgcatgtcatcccctggtacttttattttatggcattcacttttttagcaatataacatcttcttgtcattcattgcagagtgttgttagtgaaggaaagagcaatgctcttgatgtcagttttgtgcgtgcgccaattggcatggacctggattggcagctcatggcaaagatatcaccatgccatgttacggtacttatctaacccaagtactttatgtggagggaacttcatctctagtactggtcattcaggggaagtttttttttatttttaaaaatggtttggagacacaaagggtaatttttttgggcagggaaatatctatggggaaaaaagtagagggtttttgttaagtttcatggatgtgagaaaactgcgtaactcaaagcattaggaaatgatactcaaaagacactataagtgtcggtttggacagtgaaacagtcaccaagacactcctgtgaccattaatcgatagtgtgaaacacttgtaaaatgtagcaatatattttgtaactacttttggtgatgaatctagccatactattttcaaagctcaactaaaattttcaaaggccccatttggttcctcgtattggtggataaaaagtttcatcgagttctgtagatattccactcactcaaccagcaaagccacacatgtggactgcagctcacggccctgagcccattgcaagcatgatgcctcacctcttccggga

SEQ ID NO: 371 - DNA, 1106 bp, Setaria italica
ccacatcggtagatcacatccaaggtgctaaatagtgacttcaaacctgcgcttgtacacaatgtccactcatttgctgttaaatcttagtgtcaacttcttactgacgagttttcctggttcattaactttgcttttcaagtaatatgtatttttctactttgcatgtcatcccctggtacttttattttatggcattcacttttttagcaatataacatcttcttgtcattcattgcagagtgttgttagtgaaggaaagagcaatgctcttgatgtcagttttgtgcgtgcgccaattggcatggacctggattggcagctcatggcaaagatatcaccatgccatgttacggtacttatctaacccaagtactttatgtggagggaacttcatctctagtactggtcattcaggggaagtttttttttatttttaaaaatggtttggagacacaaagggtaatttttttgggcagggaaatatctatggggaaaaaagtagagggtttttgttaagtttcatggatgtgagaaaactgcgtaactcaaagcattaggaaatgatactcaaaagacactataagtgtcggtttggacagtgaaacagtcaccaagacactcctgtgaccattaatcgatagtgtgaaacacttgtaaaatgtagcaatatattttgtaactacttttggtgatgaatctagccatactattttcaaagctcaactaaaattttcaaaggccccatttggttcctcgtattggtggataaaaagtttcatcgagttctgtagatattccactcactcaaccagcaaagccacacatgtggactgcagctcacggccctgagcccattgcaagcatgatgcctcacctcttccgggaggggggccatgccacgtcggccggccaaagataccccgatcctacgtggcccaatgacgctcgggcgcacagatattgcgcccaatggcgggcggcatttggatatccccatcccgctccgtctcctctccggccgctcgtgctcgtgctcgtgctcttaatagcagccgcagattctgctccgctctcaaacgccacttgtcctccctccctcctct

SEQ ID NO: 372 - DNA, 336 bp, Setaria italica
ggataaaaagtttcatcgagttctgtagatattccactcactcaaccagcaaagccacacatgtggactgcagctcacggccctgagcccattgcaagcatgatgcctcacctcttccgggaggggggccatgccacgtcggccggccaaagataccccgatcctacgtggcccaatgacgctcgggcgcacagatattgcgcccaatggcgggcggcatttggatatccccatcccgctccgtctcctctccggccgctcgtgctcgtgctcgtgctcttaatagcagccgcagattctgctccgctctcaaacgccacttgtcctccctccctc

SEQ ID NO: 373 - DNA, 3067 bp, Setaria italica
atttaatactcctaattagtatctaacattcgacgtgataagtgttaaattagccatctaccagcacccgtaacaaatttttggggccaataaacaagaatggcgaccttttggccaccaaacactgcacacgtactccgtgtacctgtcagacgcaataacgcaacggtacaggacatagattgaggttgatgtatatcgtcctcgttttcagatcggtcagtttgctactgtgcaagcccccgactgtgggcattcgcttttcggttcggttccttggttgcgaagaaattcggttcttataaaatagaaacatatcggttctaaaaatgttcagaattggtcatttcggtttcggttatttcagttcggttccagttctaaccgaagtaaccgaattttttgaaagaggccaagacacaataaatatatgttttaaggcaaatttatgcaacactatatccattttcaatagtaaaatttataaggaaacaatagcagtataggaacacaaatatataacacaaatatatagtagttcaaatatgaaacaccaaacataaaccaaacataatcttacaaaatacaagtaagtgaagtataattcatgtaattcggttctttcggttcattcggttaattgagagtaggaactgaattttcttcagttatttcggttcctcaatatcaggaactgaataagaaaccgaatttttcggttcttttggttcggttttttagttcggttatttttgcccaggcctacgccgactggcgcggctgtccctctcgccagcacggcgcgccccacacgacagttacgcgcccgcgcgttgggcatagggggcaggccggcggatgatctgcatcacgtcgcggagggtaggagggttggtggcctgagcctgacctgcttggtgggctggtggtgcgcgtccctttcagcggttcgggccggggtgggggtgttgcgcggcgggtgatcgatgagccggcgggggcggagatgagaagcctcggcctcgccgtcgtggcggtcgagctggcaagttggcggcatcattttctggcgcgcggggaacagggggacgtccaggacgtgggatagtagtcgtactcgcacggtgcgattcggttgggtggatgaattcgctcagctcgttatttcaaaagaaaaaagaattcgctcagctctttttccttgaccaatcatatggcggccaggtcgcggcacatgcaagcgcgtgcgtgatgcttcgccttttaggggtgtttggaaacacgctcctaaacagtttaatcacatcgcatatttgatactaattatgagtattaaatatagtctaattacaaaattaattgcaaagatggagtctaattcgtgagatgaatctattaagcctaattagtccatgatttgacaatgtggtgctacagtaatcatttgctaatgatggattaagggggtgtttgggaggagggggctaaattttagccccgtcacatcgaatgtttgacactaattaggagtattaaacctagactaattacaaaactaattacacaacctctaggctaaatcgcgagacgaatctattaagcctaattagttcatgatttgacaatgtggtgctatagtaaccattcactaatgatggattaattaggcttaatagattcgtcttgcgatttagcctaggggttctgcaattagttttgtaattagcttatgtttagtcctcctaattagtatccgaacatccaatgtgacagagctaaagtttagcccctggtatccaaacgccccctaattaggcttaatagattcgtctcacgaattagtagggaatctatagttagttttataattagctcatgtttagtcctcataattagcatccgaacatctgatgtgaccctcctaaaatttagtacctcgtgtccgaacacccccgtttaatcatattttcttcgttccgttccgacaccaaaagcgagagttgatgatagctgggcgatgcttgtgccttgtgcgtttggctgggcctggtgcgccggcgtgcagatcggaggagggcgttgcgtgcccgcggcacgtatgcaacagcaacgcaaatggagccccgacagcgccgtgtatgcttgcacccaacgtctcgacgaccacgcggcacggcacgcaaaaaatctggccccggcctctgtcgcacagatctgtccaacatctcctgttcgtatgatccccctcgtgaatgcgatgcttgctaacactaaataaggtttcccctttttcctttttgcggggaaaagaattgaatgtttccctttgaaccgtgcacgccgcactgatccagccctgctcaccgggactaaaatatcgtcgccggctgactttacactacacccacccacccgtcgaccatcgccatcgacgaggtaaacagcaaagcaaaagataatcccggcctccaaacgcgtcatcggccacttgggcttgggccactcgcagggaaaaatcgtgccgaatccacatcgaccctcctatttgctattcctaccgtgcccgcgccttcgctgaacgtctcctaccccctgcgcttcttggaacgaccgcaccaacaccagagcaagggcgcagccactggccacttgttacgcaaaagaatcctatccacgacaggcggatcggggagtgggtaggtcgcggcaggtggcggtggcggtggtaggaatgaaccccgggatcgtgcgtttgtggactgccacaacgacgggtgctcgatccatgtgttctcctcaatcaaaaaagaataaaaaaaacgttaatagaatggaaaaggtgaatgcttgaggaggtttggtgggtcaacagcaacatgagagggaaatgtctttggtttccaggaaggagagagttggtgagagcgccggagtgtaaagtctaaggcactcgcctttgctttatacgaaggttaggaataatggtgccgagagcaatcaggcaacacacaccaaccctgctaaactcccgggcctcccagctcataaatagagtatcgctgcgagg

SEQ ID NO: 374 - DNA, 2983 bp, Setaria italica
cgacggcccgggctggtatttaatactcctaattagtatctaacattcgacgtgataagtgttaaattagccatctaccagcacccgtaacaaatttttggggccaataaacaagaatggcgaccttttggccaccaaacactgcacacgtactccgtgtacctgtcagacgcaataacgcaacggtacaggacatagattgaggttgatgtatatcgtcctcgttttcagatcggtcagtttgctactgtgcaagcccccgactgtgggcattcgcttttcggttcggttccttggttgcgaagaaattcggttcttataaaatagaaacatatcggttctaaaaatgttcagaattggtcatttcggtttcggttatttcagttcggttccagttctaaccgaagtaaccgaattttttgaaagaggccaagacacaataaatatatgttttaaggcaaatttatgcaacactatatccattttcaatagtaaaatttataaggaaacaatagcagtataggaacacaaatatataacacaaatatatagtagttcaaatatgaaacaccaaacataaaccaaacataatcttacaaaatacaagtaagtgaagtataattcatgtaattcggttctttcggttcattcggttaattgagagtaggaactgaattttcttcagttatttcggttcctcaatatcaggaactgaataagaaaccgaatttttcggttcttttggttcggttttttagttcggttatttttgcccaggcctacgccgactggcgcggctgtccctctcgccagcacggcgcgccccacacgacagttacgcgcccgcgcgttgggcatagggggcaggccggcggatgatctgcatcacgtcgcggagggtaggagggttggtggcctgagcctgacctgcttggtgggctggtggtgcgcgtccctttcagcggttcgggccggggtgggggtgttgcgcggcgggtgatcgatgagccggcgggggcggagatgagaagcctcggcctcgccgtcgtggcggtcgagctggcaagttggcggcatcattttctggcgcgcggggaacagggggacgtccaggacgtgggatagtagtcgtactcgcacggtgcgattcggttgggtggatgaattcgctcagctcgttatttcaaaagaaaaaagaattcgctcagctctttttccttgaccaatcatatggcggccaggtcgcggcacatgcaagcgcgtgcgtgatgcttcgccttttaggggtgtttggaaacacgctcctaaacagtttaatcacatcgcatatttgatactaattatgagtattaaatatagtctaattacaaaattaattgcaaagatggagtctaattcgtgagatgaatctattaagcctaattagtccatgatttgacaatgtggtgctacagtaatcatttgctaatgatggattaagggggtgtttgggaggagggggctaaattttagccccgtcacatcgaatgtttgacactaattaggagtattaaacctagactaattacaaaactaattacacaacctctaggctaaatcgcgagacgaatctattaagcctaattagttcatgatttgacaatgtggtgctatagtaaccattcactaatgatggattaattaggcttaatagattcgtcttgcgatttagcctaggggttctgcaattagttttgtaattagcttatgtttagtcctcctaattagtatccgaacatccaatgtgacagagctaaagtttagcccctggtatccaaacgccccctaattaggcttaatagattcgtctcacgaattagtagggaatctatagttagttttataattagctcatgtttagtcctcataattagcatccgaacatctgatgtgaccctcctaaaatttagtacctcgtgtccgaacacccccgtttaatcatattttcttcgttccgttccgacaccaaaagcgagagttgatgatagctgggcgatgcttgtgccttgtgcgtttggctgggcctggtgcgccggcgtgcagatcggaggagggcgttgcgtgcccgcggcacgtatgcaacagcaacgcaaatggagccccgacagcgccgtgtatgcttgcacccaacgtctcgacgaccacgcggcacggcacgcaaaaaatctggccccggcctctgtcgcacagatctgtccaacatctcctgttcgtatgatccccctcgtgaatgcgatgcttgctaacactaaataaggtttcccctttttcctttttgcggggaaaagaattgaatgtttccctttgaaccgtgcacgccgcactgatccagccctgctcaccgggactaaaatatcgtcgccggctgactttacactacacccacccacccgtcgaccatcgccatcgacgaggtaaacagcaaagcaaaagataatcccggcctccaaacgcgtcatcggccacttgggcttgggccactcgcagggaaaaatcgtgccgaatccacatcgaccctcctatttgctattcctaccgtgcccgcgccttcgctgaacgtctcctaccccctgcgcttcttggaacgaccgcaccaacaccagagcaagggcgcagccactggccacttgttacgcaaaagaatcctatccacgacaggcggatcggggagtgggtaggtcgcggcaggtggcggtggcggtggtaggaatgaaccccgggatcgtgcgtttgtggactgccacaacgacgggtgctcgatccatgtgttctcctcaatcaaaaaagaataaaaaaaacgttaatagaatggaaaaggtgaatgcttgaggaggtttggtgggtcaacagcaacatgagagggaaatgtctttggtttccaggaaggagagagttggtgagagcgccggagtgtaaagtctaaggcactcgcctttgctttata

SEQ ID NO: 375 - DNA, 3081 bp, Setaria italica
  misc_feature (813)..(813): y= t or c.
gttaaattagccatctaccagcacccgtaacaaatttttggggccaataaacaagaatggcgaccttttggccaccaaacactgcacacgtactccgtgtacctgtcagacgcaataacgcaacggtacaggacatagattgaggttgatgtatatcgtcctcgttttcagatcggtcagtttgctactgtgcaagcccccgactgtgggcattcgcttttcggttcggttccttggttgcgaagaaattcggttcttataaaatagaaacatatcggttctaaaaatgttcagaattggtcatttcggtttcggttatttcagttcggttccagttctaaccgaagtaaccgaattttttgaaagaggccaagacacaataaatatatgttttaaggcaaatttatgcaacactatatccattttcaatagtaaaatttataaggaaacaatagcagtataggaacacaaatatataacacaaatatatagtagttcaaatatgaaacaccaaacataaaccaaacataatcttacaaaatacaagtaagtgaagtataattcatgtaattcggttctttcggttcattcggttaattgagagtaggaactgaattttcttcagttatttcggttcctcaatatcaggaactgaataagaaaccgaatttttcggttcttttggttcggttttttagttcggttatttttgcccaggcctacgccgactggcgcggctgtccctctcgccagcacggcgcgccccacacgacagttacgcgcccgcgcgttgggcatagggggcaggccggyggatgatctgcatcacgtcgcggagggtaggagggttggtggcctgagcctgacctgcttggtgggctggtggtgcgcgtccctttcagcggttcgggccggggtgggggtgttgcgcggcgggtgatcgatgagccggcgggggcggagatgagaagcctcggcctcgccgtcgtggcggtcgagctggcaagttggcggcatcattttctggcgcgcggggaacagggggacgtccaggacgtgggatagtagtcgtactcgcacggtgcgattcggttgggtggatgaattcgctcagctcgttatttcaaaagaaaaaagaattcgctcagctctttttccttgaccaatcatatggcggccaggtcgcggcacatgcaagcgcgtgcgtgatgcttcgccttttaggggtgtttggaaacacgctcctaaacagtttaatcacatcgcatatttgatactaattatgagtattaaatatagtctaattacaaaattaattgcaaagatggagtctaattcgtgagatgaatctattaagcctaattagtccatgatttgacaatgtggtgctacagtaatcatttgctaatgatggattaagggggtgtttgggaggagggggctaaattttagccccgtcacatcgaatgtttgacactaattaggagtattaaacctagactaattacaaaactaattacacaacctctaggctaaatcgcgagacgaatctattaagcctaattagttcatgatttgacaatgtggtgctatagtaaccattcactaatgatggattaattaggcttaatagattcgtcttgcgatttagcctaggggttctgcaattagttttgtaattagcttatgtttagtcctcctaattagtatccgaacatccaatgtgacagagctaaagtttagcccctggtatccaaacgccccctaattaggcttaatagattcgtctcacgaattagtagggaatctatagttagttttataattagctcatgtttagtcctcataattagcatccgaacatctgatgtgaccctcctaaaatttagtacctcgtgtccgaacacccccgtttaatcatattttcttcgttccgttccgacaccaaaagcgagagttgatgatagctgggcgatgcttgtgccttgtgcgtttggctgggcctggtgcgccggcgtgcagatcggaggagggcgttgcgtgcccgcggcacgtatgcaacagcaacgcaaatggagccccgacagcgccgtgtatgcttgcacccaacgtctcgacgaccacgcggcacggcacgcaaaaaatctggccccggcctctgtcgcacagatctgtccaacatctcctgttcgtatgatccccctcgtgaatgcgatgcttgctaacactaaataaggtttcccctttttcctttttgcggggaaaagaattgaatgtttccctttgaaccgtgcacgccgcactgatccagccctgctcaccgggactaaaatatcgtcgccggctgactttacactacacccacccacccgtcgaccatcgccatcgacgaggtaaacagcaaagcaaaagataatcccggcctccaaacgcgtcatcggccacttgggcttgggccactcgcagggaaaaatcgtgccgaatccacatcgaccctcctatttgctattcctaccgtgcccgcgccttcgctgaacgtctcctaccccctgcgcttcttggaacgaccgcaccaacaccagagcaagggcgcagccactggccacttgttacgcaaaagaatcctatccacgacaggcggatcggggagtgggtaggtcgcggcaggtggcggtggcggtggtaggaatgaaccccgggatcgtgcgtttgtggactgccacaacgacgggtgctcgatccatgtgttctcctcaatcaaaaaagaataaaaaaaacgttaatagaatggaaaaggtgaatgcttgaggaggtttggtgggtcaacagcaacatgagagggaaatgtctttggtttccaggaaggagagagttggtgagagcgccggagtgtaaagtctaaggcactcgcctttgctttatacgaaggttaggaataatggtgccgagagcaatcaggcaacacacaccaaccctgctaaactcccgggcctcccagctcataaatagagtatcgctgcgaggccgagcagtgggcgaccctgtgagcttagctagcaagcaatcaagcactgccacctg

SEQ ID NO: 376 - DNA, 2923 bp, Setaria italica
  misc_feature (813)..(813): y= t or c.
gttaaattagccatctaccagcacccgtaacaaatttttggggccaataaacaagaatggcgaccttttggccaccaaacactgcacacgtactccgtgtacctgtcagacgcaataacgcaacggtacaggacatagattgaggttgatgtatatcgtcctcgttttcagatcggtcagtttgctactgtgcaagcccccgactgtgggcattcgcttttcggttcggttccttggttgcgaagaaattcggttcttataaaatagaaacatatcggttctaaaaatgttcagaattggtcatttcggtttcggttatttcagttcggttccagttctaaccgaagtaaccgaattttttgaaagaggccaagacacaataaatatatgttttaaggcaaatttatgcaacactatatccattttcaatagtaaaatttataaggaaacaatagcagtataggaacacaaatatataacacaaatatatagtagttcaaatatgaaacaccaaacataaaccaaacataatcttacaaaatacaagtaagtgaagtataattcatgtaattcggttctttcggttcattcggttaattgagagtaggaactgaattttcttcagttatttcggttcctcaatatcaggaactgaataagaaaccgaatttttcggttcttttggttcggttttttagttcggttatttttgcccaggcctacgccgactggcgcggctgtccctctcgccagcacggcgcgccccacacgacagttacgcgcccgcgcgttgggcatagggggcaggccggyggatgatctgcatcacgtcgcggagggtaggagggttggtggcctgagcctgacctgcttggtgggctggtggtgcgcgtccctttcagcggttcgggccggggtgggggtgttgcgcggcgggtgatcgatgagccggcgggggcggagatgagaagcctcggcctcgccgtcgtggcggtcgagctggcaagttggcggcatcattttctggcgcgcggggaacagggggacgtccaggacgtgggatagtagtcgtactcgcacggtgcgattcggttgggtggatgaattcgctcagctcgttatttcaaaagaaaaaagaattcgctcagctctttttccttgaccaatcatatggcggccaggtcgcggcacatgcaagcgcgtgcgtgatgcttcgccttttaggggtgtttggaaacacgctcctaaacagtttaatcacatcgcatatttgatactaattatgagtattaaatatagtctaattacaaaattaattgcaaagatggagtctaattcgtgagatgaatctattaagcctaattagtccatgatttgacaatgtggtgctacagtaatcatttgctaatgatggattaagggggtgtttgggaggagggggctaaattttagccccgtcacatcgaatgtttgacactaattaggagtattaaacctagactaattacaaaactaattacacaacctctaggctaaatcgcgagacgaatctattaagcctaattagttcatgatttgacaatgtggtgctatagtaaccattcactaatgatggattaattaggcttaatagattcgtcttgcgatttagcctaggggttctgcaattagttttgtaattagcttatgtttagtcctcctaattagtatccgaacatccaatgtgacagagctaaagtttagcccctggtatccaaacgccccctaattaggcttaatagattcgtctcacgaattagtagggaatctatagttagttttataattagctcatgtttagtcctcataattagcatccgaacatctgatgtgaccctcctaaaatttagtacctcgtgtccgaacacccccgtttaatcatattttcttcgttccgttccgacaccaaaagcgagagttgatgatagctgggcgatgcttgtgccttgtgcgtttggctgggcctggtgcgccggcgtgcagatcggaggagggcgttgcgtgcccgcggcacgtatgcaacagcaacgcaaatggagccccgacagcgccgtgtatgcttgcacccaacgtctcgacgaccacgcggcacggcacgcaaaaaatctggccccggcctctgtcgcacagatctgtccaacatctcctgttcgtatgatccccctcgtgaatgcgatgcttgctaacactaaataaggtttcccctttttcctttttgcggggaaaagaattgaatgtttccctttgaaccgtgcacgccgcactgatccagccctgctcaccgggactaaaatatcgtcgccggctgactttacactacacccacccacccgtcgaccatcgccatcgacgaggtaaacagcaaagcaaaagataatcccggcctccaaacgcgtcatcggccacttgggcttgggccactcgcagggaaaaatcgtgccgaatccacatcgaccctcctatttgctattcctaccgtgcccgcgccttcgctgaacgtctcctaccccctgcgcttcttggaacgaccgcaccaacaccagagcaagggcgcagccactggccacttgttacgcaaaagaatcctatccacgacaggcggatcggggagtgggtaggtcgcggcaggtggcggtggcggtggtaggaatgaaccccgggatcgtgcgtttgtggactgccacaacgacgggtgctcgatccatgtgttctcctcaatcaaaaaagaataaaaaaaacgttaatagaatggaaaaggtgaatgcttgaggaggtttggtgggtcaacagcaacatgagagggaaatgtctttggtttccaggaaggagagagttggtgagagcgccggagtgtaaagtctaaggcactcgcctttgctttata

SEQ ID NO: 377 - DNA, 987 bp, Setaria italica
gatataagtgggtaattttgatgaagattaggggttactttagtttattttatacaatggcagaggtgggtaatttagatatagttttaggaagttactttatgctacttttataatggcatatgtgagtaattttttaaaaacataatagatccaatggctacgatgatttgaggctaccgattgttggctagatgtcttgtttttttttgaatttctaggatttctctcattttctagagcgtcaacctaggattccaggtggcgtcacctggaggcttcaaaaggagcctccagttagtaattatactaataatctctcttttactagagcgtccacttaggatcctaggtagcgtccacttaggatcctaggtagcttcacctgaaagcttcaaaagaagtcttcaattagtaatagtaagatttgacatcataggtattattattgctttatataatcctgtcaaacttaaagcagtttaactcaaaaataaaattagaatcccttgtgtattgaaacaaaattagaaccccttatgtattttagaaggaaatgaagtactatagtatgtaaccaacgagacgtaacataccgtacaagttaccgaaccttaacggtcaacttattctacgttggtaaaactttgtggacgagagaagttcttgtcactgaagttagtggagaagggaagcgcgtagtcaaccagcggataagatggtaatggggccgacaccacgtcggttgcttgtcgccgccagaaatggcgcagcagaattcattctcattcatgcgccctactaaccaatgggttggttcatgaacatgtcattttcagttcggtgtattaggctggtgagctgtcctccacgctgtccaaattccaagctaccaagatgagcacactaatcaatattccaagtttccaatcccaatccaacactatataagaagctaaacaagcaagaagaagaagaagaatcaat

SEQ ID NO: 378 - DNA, 203 bp, Setaria italica
attgtttataatgatataagtgggtaattttgatgaagattaggggttactttagtttattttatacaatggcagaggtgggtaatttagatatagttttaggaagttactttatgctacttttataatggcatatgtgagtaattttttaaaaacataatagatccaatggctacgatgatttgaggctaccgattgttggc

SEQ ID NO: 379 - DNA, 908 bp, Setaria italica
aaaaacataatagatccaatggctacgatgatttgaggctaccgattgttggctagatgtcttgtttttttttgaatttctaggatttctctcattttctagagcgtcaacctaggattccaggtggcgtcacctggaggcttcaaaaggagcctccagttagtaattatactaataatctctcttttactagagcgtccacttaggatcctaggtagcgtccacttaggatcctaggtagcttcacctgaaagcttcaaaagaagtcttcaattagtaatagtaagatttgacatcataggtattattattgctttatataatcctgtcaaacttaaagcagtttaactcaaaaataaaattagaatcccttgtgtattgaaacaaaattagaaccccttatgtattttagaaggaaatgaagtactatagtatgtaaccaacgagacgtaacataccgtacaagttaccgaaccttaacggtcaacttattctacgttggtaaaactttgtggacgagagaagttcttgtcactgaagttagtggagaagggaagcgcgtagtcaaccagcggataagatggtaatggggccgacaccacgtcggttgcttgtcgccgccagaaatggcgcagcagaattcattctcattcatgcgccctactaaccaatgggttggttcatgaacatgtcattttcagttcggtgtattaggctggtgagctgtcctccacgctgtccaaattccaagctaccaagatgagcacactaatcaatattccaagtttccaatcccaatccaacactatataagaagctaaacaagcaagaagaagaagaagaatcaatcacccatcagcaatggcgctcgcaagccgccggaggctagcagcctccctcctggccct

SEQ ID NO: 380 - DNA, 984 bp, Setaria italica
ataagtgggtaattttgatgaagattaggggttactttagtttattttatacaatggcagaggtgggtaatttagatatagttttaggaagttactttatgctacttttataatggcatatgtgagtaattttttaaaaacataatagatccaatggctacgatgatttgaggctaccgattgttggctagatgtcttgtttttttttgaatttctaggatttctctcattttctagagcgtcaacctaggattccaggtggcgtcacctggaggcttcaaaaggagcctccagttagtaattatactaataatctctcttttactagagcgtccacttaggatcctaggtagcgtccacttaggatcctaggtagcttcacctgaaagcttcaaaagaagtcttcaattagtaatagtaagatttgacatcataggtattattattgctttatataatcctgtcaaacttaaagcagtttaactcaaaaataaaattagaatcccttgtgtattgaaacaaaattagaaccccttatgtattttagaaggaaatgaagtactatagtatgtaaccaacgagacgtaacataccgtacaagttaccgaaccttaacggtcaacttattctacgttggtaaaactttgtggacgagagaagttcttgtcactgaagttagtggagaagggaagcgcgtagtcaaccagcggataagatggtaatggggccgacaccacgtcggttgcttgtcgccgccagaaatggcgcagcagaattcattctcattcatgcgccctactaaccaatgggttggttcatgaacatgtcattttcagttcggtgtattaggctggtgagctgtcctccacgctgtccaaattccaagctaccaagatgagcacactaatcaatattccaagtttccaatcccaatccaacactatataagaagctaaacaagcaagaagaagaagaagaatcaat

SEQ ID NO: 381 - DNA, 740 bp, Setaria italica
acctaggattccaggtggcgtcacctggaggcttcaaaaggagcctccagttagtaattatactaataatctctcttttactagagcgtccacttaggatcctaggtagcgtccacttaggatcctaggtagcttcacctgaaagcttcaaaagaagtcttcaattagtaatagtaagatttgacatcataggtattattattgctttatataatcctgtcaaacttaaagcagtttaactcaaaaataaaattagaatcccttgtgtattgaaacaaaattagaaccccttatgtattttagaaggaaatgaagtactatagtatgtaaccaacgagacgtaacataccgtacaagttaccgaaccttaacggtcaacttattctacgttggtaaaactttgtggacgagagaagttcttgtcactgaagttagtggagaagggaagcgcgtagtcaaccagcggataagatggtaatggggccgacaccacgtcggttgcttgtcgccgccagaaatggcgcagcagaattcattctcattcatgcgccctactaaccaatgggttggttcatgaacatgtcattttcagttcggtgtattaggctggtgagctgtcctccacgctgtccaaattccaagctaccaagatgagcacactaatcaatattccaagtttccaatcccaatccaacactatataagaagctaaacaagcaagaagaagaagaagaatcaat

SEQ ID NO: 382 - DNA, 3059 bp, Setaria italica
actgatatatgcttctgtgtggtatggtcatggacacaatattacatgcttttatttggagtgtttacttaatgggttccatgctatcatatagtctttctatttatatgaagaagtatggtcttaatttctggagtgcttatcctaaagctgtaatttcacatcatcacagaaggatatgcagaatatttcttcttaaattgaaacaacattgattcctagatatgtaacggtcaggttgagtttatggtagtaacttgttggcatggtgatgcagcagaagcatatctttgatcaaaaatattttcttactaggtgtgctctagagctaaattctaaaatctatattgtgaacatcatgtcttctactgagagctcatatcagcccatcagctgccagtgttcgctagaactgtaaagctattatccaatagctctgattgcgttctcttttatctgtgcattctctaggccgtgacaaaatcagaacctccagaaaaggcattaagtagtgatgcacaaccaactcaagttattactgagctccgaaggagctatactagtaaattggaagaggtatgcttctatggaaacataattttttttaatctgtgttaattctgattctttactcaacatgcatttttgcattttctgtgcatctttcagtcagagaagcggaaacaggaattgttagctcaattggccgcagaagaacaacatggtcatgagctcacaaaaatagttagagaactgctacctactcctaagaagactgcaaatctacaaaggcagccgcggcacagaagggtaaacttgcttggttgccgttgtttccagttactacccacggattaaaaatttgatgtgaattttcttccagaggagcaatgatagatcaaaggtgtcaaaacgacttactgaagaggccgagcaatactttgaagatttcctatcaaacgttgaagacaccgacttttcatcttttgatggagaaagaagtgacacaagttcaacaaggaaagatgtgttacatcatgctatgatggaaactccagtggctctcccgaaagttgcttcacctgctgaggcagatggcgttgtccttccttggctgcaatgggaaactgccaatgatcttcaaacctccccatgcaaaaccaaggctgaggtaacgatgacaccattttctatagaagtagtaatatgtttcttattcttaaaatgtagaatattacacattactcttaaatggaaaggatgttttgtgaaatggctgagctaatattttcaacattaatgccaccaacatgttaccttttctctgattgcatggcgaattgatcattttcagggagaaagcatggcatgcagcaactagcaatcagactgtgagcagccgtgggagctggagccctggagactactccacttcaaactgcctctaaagataaaactgctggccaggtttgaggaggtcgggattcgccaaagcagctgcccttcatttttgcgggaaacctcgtcatttcacattgacgactatctgcatctgcggcagagtgaggacctcctctttgagaagtggaggcagaagcaaagaatcgagtctggcggcctgttcctgtgcagtagaccgacaatattgtagattatggccaattatttatcggcctggtcctggcaggatgagtgtagtagtgtacctaatttggtaggcaatgggtttgagttaggccaataaatgtgcaggtttacatttggttgccatgttagttcataacttcatacacttccatttttgtacgtcggcgatgtttcaaccagaacagattatgtttccttgggactgtaaatttcttcatcgctccatcccaatgaacttgcaagagattcgtgttagcaaccaaaattgctctgtccttcccaaaaagcattgcctctggatcttttccgatcaagatcagaaaccctatatgtattgttcttatgttctgctgtgggtcgttggttcttgtcacccttaaacttctctgtttggtacccagataaatacaaattcggctggtgggtagaaaaaccgcctacgaacactggtttcaccttataagactactgcactgtttctagcaggcttatttttctcttcgttttttatattccaatgtatacatattaatgtttatcgagctatgatcttataaatttgtacatgcttcaatattttctaaaaacttgaataacagtatgtaaaacctaggttgatgtttcaaatgaacttatttaacattttacgttgaaacagtacatcgcgaatggcatattattttgttgcatttattctaaacaccttaaaatggaatttgaaaacgggctctaagtttgagagaagtttaagggtaatagtattctaaacacttcaagtttgagatccaaaataattaatctctcacctatcacctccaatcaagttgtttatcagtttatgccatgtacatgtatcgctggtttgttatttcacctcattttcgctatgtatctactactattgcgctaatctcaaatattagatgacatgtaaactaaaatctttggaaagattaataggatacccgcgggtgctgatatctgtttctaaaaatgttgaatctaactatttgtaaatattgatatatttttcagaaatgttggatttagtcttgtgaaatgttgaaccgatatctctgatatggatttaatgggcttaaagcttccactagccgtgtgcatgggcgaaaaaaaatcttggccaagtgttactccgtcgcggccacacgccacaagtcctcccggccctcgctcgccccttatcccatcgtacccgccacacggcgcgccaccagtggcgccgcggatgcgcctcatctccccggcggccacctcgcgcggtttagatttccctgggcccccctcgcggtaccgtcacatatttttggcgcctcttcttctgcgcccctctcctcccgaaccgcagataccaccgagtcggcagctgaacacaagcaacaagcaagtgatcc

SEQ ID NO: 383 - DNA, 1140 bp, Setaria italica
ccacatcggtagatcacatccaaggtgctaaatagtgacttcaaacctgcgcttgtacacaatgtccactcatttgctgttaaatcttagtgtcaacttcttactgacgagttttcctggttcattaactttgcttttcaagtaatatgtatttttctactttgcatgtcatcccctggtacttttattttatggcattcacttttttagcaatataacatcttcttgtcattcattgcagagtgttgttagtgaaggaaagagcaatgctcttgatgtcagttttgtgcgtgcgccaattggcatggacctggattggcagctcatggcaaagatatcaccatgccatgttacggtacttatctaacccaagtactttatgtggagggaacttcatctctagtactggtcattcaggggaagtttttttttatttttaaaaatggtttggagacacaaagggtaatttttttgggcagggaaatatctatggggaaaaaagtagagggtttttgttaagtttcatggatgtgagaaaactgcgtaactcaaagcattaggaaatgatactcaaaagacactataagtgtcggtttggacagtgaaacagtcaccaagacactcctgtgaccattaatcgatagtgtgaaacacttgtaaaatgtagcaatatattttgtaactacttttggtgatgaatctagccatactattttcaaagctcaactaaaattttcaaaggccccatttggttcctcgtattggtggataaaaagtttcatcgagttctgtagatattccactcactcaaccagcaaagccacacatgtggactgcagctcacggccctgagcccattgcaagcatgatgcctcacctcttccgggaggggggccatgccacgtcggccggccaaagataccccgatcctacgtggcccaatgacgctcgggcgcacagatattgcgcccaatggcgggcggcatttggatatccccatcccgctccgtctcctctccggccgctcgtgctcgtgctcgtgctcttaatagcagccgcagattctgctccgctctcaaacgccacttgtcctccctccctcctctcgtctccccgtcacctcaggatcagcaagcggca

SEQ ID NO: 384 - DNA, 999 bp, Setaria italica
gatataagtgggtaattttgatgaagattaggggttactttagtttattttatacaatggcagaggtgggtaatttagatatagttttaggaagttactttatgctacttttataatggcatatgtgagtaattttttaaaaacataatagatccaatggctacgatgatttgaggctaccgattgttggctagatgtcttgtttttttttgaatttctaggatttctctcattttctagagcgtcaacctaggattccaggtggcgtcacctggaggcttcaaaaggagcctccagttagtaattatactaataatctctcttttactagagcgtccacttaggatcctaggtagcgtccacttaggatcctaggtagcttcacctgaaagcttcaaaagaagtcttcaattagtaatagtaagatttgacatcataggtattattattgctttatataatcctgtcaaacttaaagcagtttaactcaaaaataaaattagaatcccttgtgtattgaaacaaaattagaaccccttatgtattttagaaggaaatgaagtactatagtatgtaaccaacgagacgtaacataccgtacaagttaccgaaccttaacggtcaacttattctacgttggtaaaactttgtggacgagagaagttcttgtcactgaagttagtggagaagggaagcgcgtagtcaaccagcggataagatggtaatggggccgacaccacgtcggttgcttgtcgccgccagaaatggcgcagcagaattcattctcattcatgcgccctactaaccaatgggttggttcatgaacatgtcattttcagttcggtgtattaggctggtgagctgtcctccacgctgtccaaattccaagctaccaagatgagcacactaatcaatattccaagtttccaatcccaatccaacactatataagaagctaaacaagcaagaagaagaagaagaatcaatcacccatcagca

SEQ ID NO: 385 - DNA, 996 bp, Setaria italica
ataagtgggtaattttgatgaagattaggggttactttagtttattttatacaatggcagaggtgggtaatttagatatagttttaggaagttactttatgctacttttataatggcatatgtgagtaattttttaaaaacataatagatccaatggctacgatgatttgaggctaccgattgttggctagatgtcttgtttttttttgaatttctaggatttctctcattttctagagcgtcaacctaggattccaggtggcgtcacctggaggcttcaaaaggagcctccagttagtaattatactaataatctctcttttactagagcgtccacttaggatcctaggtagcgtccacttaggatcctaggtagcttcacctgaaagcttcaaaagaagtcttcaattagtaatagtaagatttgacatcataggtattattattgctttatataatcctgtcaaacttaaagcagtttaactcaaaaataaaattagaatcccttgtgtattgaaacaaaattagaaccccttatgtattttagaaggaaatgaagtactatagtatgtaaccaacgagacgtaacataccgtacaagttaccgaaccttaacggtcaacttattctacgttggtaaaactttgtggacgagagaagttcttgtcactgaagttagtggagaagggaagcgcgtagtcaaccagcggataagatggtaatggggccgacaccacgtcggttgcttgtcgccgccagaaatggcgcagcagaattcattctcattcatgcgccctactaaccaatgggttggttcatgaacatgtcattttcagttcggtgtattaggctggtgagctgtcctccacgctgtccaaattccaagctaccaagatgagcacactaatcaatattccaagtttccaatcccaatccaacactatataagaagctaaacaagcaagaagaagaagaagaatcaatcacccatcagca

SEQ ID NO: 386 - DNA, 752 bp, Setaria italica
acctaggattccaggtggcgtcacctggaggcttcaaaaggagcctccagttagtaattatactaataatctctcttttactagagcgtccacttaggatcctaggtagcgtccacttaggatcctaggtagcttcacctgaaagcttcaaaagaagtcttcaattagtaatagtaagatttgacatcataggtattattattgctttatataatcctgtcaaacttaaagcagtttaactcaaaaataaaattagaatcccttgtgtattgaaacaaaattagaaccccttatgtattttagaaggaaatgaagtactatagtatgtaaccaacgagacgtaacataccgtacaagttaccgaaccttaacggtcaacttattctacgttggtaaaactttgtggacgagagaagttcttgtcactgaagttagtggagaagggaagcgcgtagtcaaccagcggataagatggtaatggggccgacaccacgtcggttgcttgtcgccgccagaaatggcgcagcagaattcattctcattcatgcgccctactaaccaatgggttggttcatgaacatgtcattttcagttcggtgtattaggctggtgagctgtcctccacgctgtccaaattccaagctaccaagatgagcacactaatcaatattccaagtttccaatcccaatccaacactatataagaagctaaacaagcaagaagaagaagaagaatcaatcacccatcagca

SEQ ID NO: 387 - DNA, 1148 bp, Setaria italica
ggtgacgagcatggacagtggcatgcagcatgtggatgggaacgccgtaacaagtgtcgattccggaggccacgggggtgtccgggacctccatctcgggactcgattttcgctaggacctcctctggatgtgacttgtctcttctgtgcaccgatgcacgctgctgcggcgtcggcgattgcaagcatctctcgactgcactgacgggcctctccctcgtatgggtagcctagccatcaactttcctgccctgtttccttcccgcacgcaaggctatgcaacaaaacctttgttagctgccaagctgatggcttttgctcgcttggaggcgacaggtgttgatacctcccatgtgatcgttgcaacagagaacctcgtggagttgtgggagtactagcgtccacccatgcgttaggaacgcagtatccaaccattccaacccccttctggccttctcaactatttgtcaaaattgttaagttaactaaacaatacaaccctgcgttctttttggctcatattgttatttgttcgttccgacctatatagattatgttttatatctctacaatttgctcttgttgtataaactacatgttcaactgatccggttagaatgacatgataatgataatgataataataatgatggtggagggtgcatagtacaaactcccattccataagatggtataatttgttctagatatatagactttttgttctatgtaaataaaattttgctcaacttatattcactttaaaaaatggtagttaaaggatggtggagggtgtagcgttttgttatgtcagcttttgtatgattcgctctctgtgtataatatttttttcacttacataaattttgttctagttaagatggcagtgtgaggagagaagggggcagatgacaacacccggtatattctctctcttcctcctcttcttgagagaggagttctctgtctcgaagaaccttttcatattcttcttttccgcaggctccccggctccatgggccgcagcctgtttgtgtgtgaacggaatagcggcccagagaacgcgcgcggtcgacatggtcgcgaatcgcgatttcgctgccttttttcttttcccgtttttataaataaatcagcccgaaaaaagg

SEQ ID NO: 388 - DNA, 1603 bp, Setaria italica
gcataaatactggcgaaatgttccttgtgatctctgatactgacagtgttgctgttcagagcttcaagtgccgtgtgcatgttgaacttggggagctaccagcagtgagtgctagtttgaagttggaaccaaggcctagcttagctttgtatcacatcaccgttgggatttcctgttttcttaggttgggtttgaattatgtgctcctcttaatggaaaaaaaaagctatactaccaagttcgaattccgattcagacccggagacatggcgcagaaactgctgaacatacggcgacttgtttggatggtcgtggtcctcgagatcgcgagatagaggaaaacaagcgatccatgtggatttccatggaagcgataggtagtgtggacagaggcttgttgaattctattccatccactttaaacagtatttggagcgcccgctatagcactgtaaggtagtggacccaagatagtctatttggacttcgaagccattaatgtccactagtgcccagtatcgtggtcgctattgcttatgttagacagctattcgctacatttatggttaaagtgacataggaatatgaatcaaacagtaataataatatttaaaatgattattcaggtaatgacgaaaaattattgggatgacaagtgaattttttttattcattgatacgaggatttaatgttaatatacatccatacatcttaattatactatttatttatgattcgtaccatgagatgcaattgctaacttgaaactaactttttttaagtgagcttgatgttaatattcatatatcctctaaaattgtgactattttctgaattccgctatttggacttagcgtccgctatagcactcgctatccgcgatctgctacaccagcactaatccgctaccataccgctaaacgctatttagtaccttgcccagtggcccggagcgttgtttgtgttgggccagagaactgtcaggtacgcgctgcacatccttttgctggttcagtggttctgcattcatctttgcacactttgcagacattgggctatgtctccgtgtgctccaatttgtgaaaatctgtaaatggaagacaaataggcatgcatgcataatgatcatgttgtgtacagttggctatgcttctggcttgaataatctttgtttaattatcaacaaaaagaatctttgttcatatgcccccaaacactttcagccaacgtacttgtcttaagtacaagctctattgataatagatgaaatttagtattctacgagtacgctggagcaatattgctattatttgggatgtgctcttccatcttcgatcaactttacgccgcatgatgcatgtgtacacaatgagaatacttcttgctggtctagccactctgaaaatcatagcccatggatatgaacaagtactatctacttgtacaccctacaatggttaatccaaaaaggatcggaagcattgatagaaattatgagaactgcaggaaacagtgaaattgtttctaactaattagtattactgaaaaacatatccttcttcataacatacacaaactattatttctgatattaaaactttg

SEQ ID NO: 389 - DNA, 1603 bp, Setaria italica; identical to SEQ ID NO: 41

SEQ ID NO: 390 - DNA, 2162 bp, Setaria italica
gcccttactatagggcacgcgtggtcgacggcccgggctggtaaactttaaagcgaaaacaaaaatatatcacaagtcaagcaatctcacttttaaggtaactgaactctactgtctgtgaacaacttataacataatttattagcacacaatttcatacagaaaaatatggtgatataccaccaaatgataccataacgctgaaactttttaaggtagccaccactaacctcaaaatcccagaacaatccacgctcactcatctttagctctctattttctccacagccgcttggccattccctgccctgcatgttttccaaagctgcttgtccaatgtccacagtagagaaaataggaatggcttgccttcagtgctaggccaaaccttgaaaactcaggtgcaaccgctgccttggagtatctacgtattctgaggtctcaacttcaaatgccttgtgtgaccagacagggcacttgttgttctataggttgcaacaagttgcccaccatggtgctactgattgaacaactggcttatttcaggcacactaaccttggtttaagttgtgatgttggggcagaacggttgtcaaatccaacagtagagagtggaggacaaagataggttaagaaagatgatggagaagggttttctcacatcttttcttattagtgggtgggtcttgggtgtgggtggataaaattggacaacctatttttagtggtattttctgaactatctgtgtgcagatctgccctataatggatatttcattataattctactgataatttatcattatccatatttgctcttacattaatgtttggcagtttgaccgcatcttttctgaaattaaaggtcctgcctaacatcattgatcgccaatgacacctacagcctagtcgatgaattgaccagttattagaaggctagtgcaaattcttcgaaatcctgttccatcagatgttaacagaaatgtaccgagatatttgaagtagcggtaaaggtataattctgtgagagtgacaacaagtgcttgcacataaataacataaataggaacttcctctaatctacgttcaaattttatgttattactatcagtattttatttcacggtgagaacgaaaacttcaattcttctattagaggacatactattgtctgataccataaattacattggatttgtttggtctcccagcctattgtttcttttgcacctcacattgttttcagtatcccaatttggctagtaaaagaacatgactattgtaatgcagtgtttattgttttcatcatttcttcctcctctattccagggacactgttgttgctttattcgacgagctggttatcaacaccaagaagcttgtgacggcaacttcaaaagggatcgaaaaatggcgttgagctgcaccaccgcgtcattgtcgatattagctgccttcaactgcggtgtatcaagtgaagattagaagcagtgtttatcttgaacaagcagtggcacttagatctagaatccagactgtcgcatcgtatggctttctcttgctcatcagttagtagctttgtatctaagtaggatcctgaaatgaggccgacgatatctggtagatatatttagttacatgccattgtgttgagtgatgtccctggtgctgggttgctcatcacagatattaaattttagaatgaattgatgtgtgagattcagatgaactatgatttgtgcttgtgcgcgtgttcttcaccctcttggtaccagtgtgtggcctggaattgctgtcttggttctttctctatcactggttggttctccctccgtctccatctatcatgtttgttagtccctatactactgacaaaaaagttcaccagaggccctaatgctgccacatcagcgccctctaaagttgccatatcagcatcctcatctgccaagtcggcacagcctgcccaatcgcatccaagcaacagatagccctcctgggcacccagccaatggcagctcccatggccaaatctcagatgggcccacagcatcctccgatccccatttccatccatttaaactagctcaccttttcctccacaaacgcccatcagccatccccctcctgcaattcttcctctgaactgtgggtctgcggca

SEQ ID NO: 391 - DNA, 2162 bp, Setaria italica
gcccttactatagggcacgcgtggtcgacggcccgggctggtaaactttaaagcgaaaacaaaaatatatcacaagtcaagcaatctcacttttaaggtaactgaactctactgtctgtgaacaacttataacataatttattagcacacaatttcatacagaaaaatatggtgatataccaccaaatgataccataacgctgaaactttttaaggtagccaccactaacctcaaaatcccagaacaatccacgctcactcatctttagctctctattttctccacagccgcttggccattccctgccctgcatgttttccaaagctgcttgtccaatgtccacagtagagaaaataggaatggcttgccttcagtgctaggccaaaccttgaaaactcaggtgcaaccgctgccttggagtatctacgtattctgaggtctcaacttcaaatgccttgtgtgaccagacagggcacttgttgttctataggttgcaacaagttgcccaccatggtgctactgattgaacaactggcttatttcaggcacactaaccttggtttaagttgtgatgttggggcagaacggttgtcaaatccaacagtagagagtggaggacaaagataggttaagaaagatgatggagaagggttttctcacatcttttcttattagtgggtgggtcttgggtgtgggtggataaaattggacaacctatttttagtggtattttctgaactatctgtgtgcagatctgccctataatggatatttcattataattctactgataatttatcattatccatatttgctcttacattaatgtttggcagtttgaccgcatcttttctgaaattaaaggtcctgcctaacatcatttgaatcgcctaagtactacagcctagtcgatgaattgaccagttattagaaggctagtgcaaattcttcgaaatcctgttccatcagatgttaacagaaatgtaccgagatatttgaagtagcggtaaaggtataattctgtgagagtgacaacaagtgcttgcacataaataacataaataggaacttcctctaatctacgttcaaattttatgttattactatcagtattttatttcacggtgagaacgaaaacttcaattcttctattagaggacatactattgtctgataccataaattacattggatttgtttggtctcccagcctattgtttcttttgcacctcacattgttttcagtatcccaatttggctagtaaaagaacatgactattgtaatgcagtgtttattgttttcatcatttcttcctcctctattccagggacactgttgttgctttattcgacgagctggttatcaacaccaagaagcttgtgacggcaacttcaaaagggatcgaaaaatggcgttgagctgcaccaccgcgtcattgtcgatattagctgccttcaactgcggtgtatcaagtgaagattagaagcagtgtttatcttgaacaagcagtggcacttagatctagaatccagactgtcgcatcgtatggctttctcttgctcatcagttagtagctttgtatctaagtaggatcctgaaatgaggccgacgatatctggtagatatatttagttacatgccattgtgttgagtgatgtccctggtgctgggttgctcatcacagatattaaattttagaatgaattgatgtgtgagattcagatgaactatgatttgtgcttgtgcgcgtgttcttcaccctcttggtaccagtgtgtggcctggaattgctgtcttggttctttctctatcactggttggttctccctccgtctccatctatcatgtttgttagtccctatactactgacaaaaaagttcaccagaggccctaatgctgccacatcagcgccctctaaagttgccatatcagcatcctcatctgccaagtcggcacagcctgcccaatcgcatccaagcaacagatagccctcctgggcacccagccaatggcagctcccatggccaaatctcagatgggcccacagcatcctccgatccccatttccatccatttaaactagctcaccttttcctccacaaacgcccatcagccatccccctcctgcaattcttcctctgaactgtgggtctgcggca

SEQ ID NO: 392 - DNA, 2118 bp, Setaria italica
ccacttgaatctctcctcttttatttaaggactgctaatttcttagtttacttggtctacccttttgcattgtccctcttgccaatacgtttccagtgacagaaaactcacccaacttaactatatattggcagggaaaagaagaagagagaggaaagatcagaaactccaaagccgaatgaagctgttacgaaatttgatggagacctttattccatgaggcattaggtcagccttccgcagaggagagtttccgtggataacagacttaacagtaacctctggactgtattgagagaatatcgatcatcccctttcaccacagagacatctttggctgctcgtcgtgtggtgtagcgttctgccgtacaaagtatccagattattcttgctattgaacagatatttgtattttctcatgtatcttcaaatgtattcattctcaccgcttgttcgaaagtatatgaagaagtatgtgggaaccaatgttactcgtaagcagagaaatatagctttcctcttttgtattttggtggagatgtattgtggtgaacatgaaatcagttgatgtgttgtttgtctgaatttctatgtacctggcacagtgaactggaaaatatcttaggtggaaagcacaagtcactagaccatttgcgctggattcacctgtgtgagaaaactgcaacattttcactttgttagctaggaagcaaggccatgttccattggctgcctggctgggcatttttaggactgctccgcttaaaaaaaaaataacttcactccaccaacttaaagctccactccaactaagaaaatagggagctacgaggttaatagtgtaaacttcagctccaaaaattataggaattggcgagaatggtctctcttgcccttggttgggattgatgtttttttttaccagctacgttaaccgactgctacagtaccgatcgctacggtaacactttgctacatcgcttcgcctactttgcagacttcattgtgcgcagctgaccgttggaatttttctggaataaaactccgcgtcattgtaataaaggatcacttttgaaaaccagcacgatcgtcatgtgttcgtatgaggtcattcggtagtccatgatactgaaagtgatttgtatccttttccaaaaagaatccgcagaaatcttcacaaagtaagttgatttggactaccataagaaatccagtgctctcaaatgttgcagaatagtttacgtcatacgcgttgaaaattatgccacccgaagattgcgaccatcttaaagcattgaaaattgatgtggcctgcgacattgggcccaggagatgaatcatccagcatttcagcaaaccgggctcaccaaggatgcagatgaccaaattggggtgaaatcggacgccagaggaaggggagatggcggcgacgacggaatagaagagtgtgagagggagggagaggcggcagcgatggaagatgaacaagcacggggaggtgtcaatcttttttccccctaaatcggtatgtgtaattggtgacattagtgagtaattttcaactaacttctattggaatgaaacttgtattttcgaagcaccctttgagaagctccagaaaaaatcttgaagttagctcctagatgcatattttttccttgaagttagtattattagagctagaaatgtttggcaagataattttaaagtggagttagaaaatctaaagcgaagcggtccaaacacgcctttgagatccgttaccgtcaacaacagaagcagagagcttcacgcccattttgagttccaaaaccacgtgatctccaaaatcattttggccgatatttcccagccccaggcactccgaagaccacaaatctcaggcgctccagacgctctcctcccaatcacggccctccacgtgtcccgaggccctccgccagcagcccatccattggaccatgcagataagacccggataaggcagagcccatcgctgccgtcaaatagatcacatccgtcccagggccgtccgatctgccacgcaggagatagcaccggaactctttcttatttgtaccccgggacgagccctctccacgccacacaccaccacca

SEQ ID NO: 393 - DNA, 2080 bp, Setaria italica
ggactgctaatttcttagtttacttggtctacccttttgcattgtccctcttgccaatacgtttccagtgacagaaaactcacccaacttaactatatattggcagggaaaagaagaagagagaggaaagatcagaaactccaaagccgaatgaagctgttacgaaatttgatggagacctttattccatgaggcattaggtcagccttccgcagaggagagtttccgtggataacagacttaacagtaacctctggactgtattgagagaatatcgatcatcccctttcaccacagagacatctttggctgctcgtcgtgtggtgtagcgttctgccgtacaaagtatccagattattcttgctattgaacagatatttgtattttctcatgtatcttcaaatgtattcattctcaccgcttgttcgaaagtatatgaagaagtatgtgggaaccaatgttactcgtaagcagagaaatatagctttcctcttttgtattttggtggagatgtattgtggtgaacatgaaatcagttgatgtgttgtttgtctgaatttctatgtacctggcacagtgaactggaaaatatcttaggtggaaagcacaagtcactagaccatttgcgctggattcacctgtgtgagaaaactgcaacattttcactttgttagctaggaagcaaggccatgttccattggctgcctggctgggcatttttaggactgctccgcttaaaaaaaaaataacttcactccaccaacttaaagctccactccaactaagaaaatagggagctacgaggttaatagtgtaaacttcagctccaaaaattataggaattggcgagaatggtctctcttgcccttggttgggattgatgtttttttttaccagctacgttaaccgactgctacagtaccgatcgctacggtaacactttgctacatcgcttcgcctactttgcagacttcattgtgcgcagctgaccgttggaatttttctggaataaaactccgcgtcattgtaataaaggatcacttttgaaaaccagcacgatcgtcatgtgttcgtatgaggtcattcggtagtccatgatactgaaagtgatttgtatccttttccaaaaagaatccgcagaaatcttcacaaagtaagttgatttggactaccataagaaatccagtgctctcaaatgttgcagaatagtttacgtcatacgcgttgaaaattatgccacccgaagattgcgaccatcttaaagcattgaaaattgatgtggcctgcgacattgggcccaggagatgaatcatccagcatttcagcaaaccgggctcaccaaggatgcagatgaccaaattggggtgaaatcggacgccagaggaaggggagatggcggcgacgacggaatagaagagtgtgagagggagggagaggcggcagcgatggaagatgaacaagcacggggaggtgtcaatcttttttccccctaaatcggtatgtgtaattggtgacattagtgagtaattttcaactaacttctattggaatgaaacttgtattttcgaagcaccctttgagaagctccagaaaaaatcttgaagttagctcctagatgcatattttttccttgaagttagtattattagagctagaaatgtttggcaagataattttaaagtggagttagaaaatctaaagcgaagcggtccaaacacgcctttgagatccgttaccgtcaacaacagaagcagagagcttcacgcccattttgagttccaaaaccacgtgatctccaaaatcattttggccgatatttcccagccccaggcactccgaagaccacaaatctcaggcgctccagacgctctcctcccaatcacggccctccacgtgtcccgaggccctccgccagcagcccatccattggaccatgcagataagacccggataaggcagagcccatcgctgccgtcaaatagatcacatccgtcccagggccgtccgatctgccacgcaggagatagcaccggaactctttcttatttgtaccccgggacgagccctctccacgccacac

SEQ ID NO: 394 - DNA, 2090 bp, Setaria italica
ggactgctaatttcttagtttacttggtctacccttttgcattgtccctcttgccaatacgtttccagtgacagaaaactcacccaacttaactatatattggcagggaaaagaagaagagagaggaaagatcagaaactccaaagccgaatgaagctgttacgaaatttgatggagacctttattccatgaggcattaggtcagccttccgcagaggagagtttccgtggataacagacttaacagtaacctctggactgtattgagagaatatcgatcatcccctttcaccacagagacatctttggctgctcgtcgtgtggtgtagcgttctgccgtacaaagtatccagattattcttgctattgaacagatatttgtattttctcatgtatcttcaaatgtattcattctcaccgcttgttcgaaagtatatgaagaagtatgtgggaaccaatgttactcgtaagcagagaaatatagctttcctcttttgtattttggtggagatgtattgtggtgaacatgaaatcagttgatgtgttgtttgtctgaatttctatgtacctggcacagtgaactggaaaatatcttaggtggaaagcacaagtcactagaccatttgcgctggattcacctgtgtgagaaaactgcaacattttcactttgttagctaggaagcaaggccatgttccattggctgcctggctgggcatttttaggactgctccgcttaaaaaaaaaataacttcactccaccaacttaaagctccactccaactaagaaaatagggagctacgaggttaatagtgtaaacttcagctccaaaaattataggaattggcgagaatggtctctcttgcccttggttgggattgatgtttttttttaccagctacgttaaccgactgctacagtaccgatcgctacggtaacactttgctacatcgcttcgcctactttgcagacttcattgtgcgcagctgaccgttggaatttttctggaataaaactccgcgtcattgtaataaaggatcacttttgaaaaccagcacgatcgtcatgtgttcgtatgaggtcattcggtagtccatgatactgaaagtgatttgtatccttttccaaaaagaatccgcagaaatcttcacaaagtaagttgatttggactaccataagaaatccagtgctctcaaatgttgcagaatagtttacgtcatacgcgttgaaaattatgccacccgaagattgcgaccatcttaaagcattgaaaattgatgtggcctgcgacattgggcccaggagatgaatcatccagcatttcagcaaaccgggctcaccaaggatgcagatgaccaaattggggtgaaatcggacgccagaggaaggggagatggcggcgacgacggaatagaagagtgtgagagggagggagaggcggcagcgatggaagatgaacaagcacggggaggtgtcaatcttttttccccctaaatcggtatgtgtaattggtgacattagtgagtaattttcaactaacttctattggaatgaaacttgtattttcgaagcaccctttgagaagctccagaaaaaatcttgaagttagctcctagatgcatattttttccttgaagttagtattattagagctagaaatgtttggcaagataattttaaagtggagttagaaaatctaaagcgaagcggtccaaacacgcctttgagatccgttaccgtcaacaacagaagcagagagcttcacgcccattttgagttccaaaaccacgtgatctccaaaatcattttggccgatatttcccagccccaggcactccgaagaccacaaatctcaggcgctccagacgctctcctcccaatcacggccctccacgtgtcccgaggccctccgccagcagcccatccattggaccatgcagataagacccggataaggcagagcccatcgctgccgtcaaatagatcacatccgtcccagggccgtccgatctgccacgcaggagatagcaccggaactctttcttatttgtaccccgggacgagccctctccacgccacacaccaccacca

SEQ ID NO: 395 - DNA, 2119 bp, Setaria italica
ccacttgaatctctcctcttttatttaaggactgctaatttcttagtttacttggtctacccttttgcattgtccctcttgccaatacgtttccagtgacagaaaactcacccaacttaactatatattggcagggaaaagaagaagagagaggaaagatcagaaactccaaagccgaatgaagctgttacgaaatttgatggagacctttattccatgaggcattaggtcagccttccgcagaggagagtttccgtggataacagacttaacagtaacctctggactgtattgagagaatatcgatcatcccctttcaccacagagacatctttggctgctcgtcgtgtggtgtagcgttctgccgtacaaagtatccagattattcttgctattgaacagatatttgtattttctcatgtatcttcaaatgtattcattctcaccgcttgttcgaaagtatatgaagaagtatgtgggaaccaatgttactcgtaagcagagaaatatagctttcctcttttgtattttggtggagatgtattgtggtgaacatgaaatcagttgatgtgttgtttgtctgaatttctatgtacctggcacagtgaactggaaaatatcttaggtggaaagcacaagtcactagaccatttgcgctggattcacctgtgtgagaaaactgcaacattttcactttgttagctaggaagcaaggccatgttccattggctgcctggctgggcatttttaggactgctccgcttaaaaaaaaaaataacttcactccaccaacttaaagctccactccaactaagaaaatagggagctacgaggttaatagtgtaaacttcagctccaaaaattataggaattggcgagaatggtctctcttgcccttggttgggattgatgtttttttttaccagctacgttaaccgactgctacagtaccgatcgctacggtaacactttgctacatcgcttcgcctactttgcagacttcattgtgcgcagctgaccgttggaatttttctggaataaaactccgcgtcattgtaataaaggatcacttttgaaaaccagcacgatcgtcatgtgttcgtatgaggtcattcggtagtccatgatactgaaagtgatttgtatccttttccaaaaagaatccgcagaaatcttcacaaagtaagttgatttggactaccataagaaatccagtgctctcaaatgttgcagaatagtttacgtcatacgcgttgaaaattatgccacccgaagattgcgaccatcttaaagcattgaaaattgatgtggcctgcgacattgggcccaggagatgaatcatccagcatttcagcaaaccgggctcaccaaggatgcagatgaccaaattggggtgaaatcggacgccagaggaaggggagatggcggcgacgacggaatagaagagtgtgagagggagggagaggcggcagcgatggaagatgaacaagcacggggaggtgtcaatcttttttccccctaaatcggtatgtgtaattggtgacattagtgagtaattttcaactaacttctattggaatgaaacttgtattttcgaagcaccctttgagaagctccagaaaaaatcttgaagttagctcctagatgcatattttttccttgaagttagtattattagagctagaaatgtttggcaagataattttaaagtggagttagaaaatctaaagcgaagcggtccaaacacgcctttgagatccgttaccgtcaacaacagaagcagagagcttcacgcccattttgagttccaaaaccacgtgatctccaaaatcattttggccgatatttcccagccccaggcactccgaagaccacaaatctcaggcgctccagacgctctcctcccaatcacggccctccacgtgtcccgaggccctccgccagcagcccatccattggaccatgcagataagacccggataaggcagagcccatcgctgccgtcaaatagatcacatccgtcccagggccgtccgatctgccacgcaggagatagcaccggaactctttcttatttgtaccccgggacgagccctctccacgccacacaccaccacca

SEQ ID NO: 396 - DNA, 381 bp, Setaria italica
aataagtttagagacgaccggcgcaatttggttttttttcccacaacaactgatgtacacatcgttctcataaaggcttccaatcaattgtggtttgtgcattgcttaataaatgtcggttagtgcactatttcactagtaaaatttaggacatgctggttgttttcatgtaatttattcaaaatttcttgtatttcagttagaagaagaagaactgcacgaggaaaagaagaagaagaataagacagggcccagcagtgcattttcaaatcttttgttgccaatgattgagtcatctttacaaggaccacgacgaatcttctctccgaggaactcctataaataccggcctgcagctcggatccatcatcacacaacaca

SEQ ID NO: 397 - DNA, 3308 bp, Setaria italica
cctaaggtaggttagtaaagagattaaaaatggtgggttaatctttatgggtagtttagtgttggcttgcaactttatcatgaaaataggttgtatagtcacttgttggcttgcaactttatcatgaaggaaagttgtatagtcatgtgttcaaaagtttgcatctctaacccctgcatgtactaaatcgtagacactgaagctccaaaagtggaattcttggatttctctgaagaaccttcggagtttgaggagatttttgagttgatcccctgtgaagccggaccttcggacaacactaacctttttacagatcaaggcaagccccggtgcatctatacctacctactttggagttattatttcatgtgttcaattgttggttattttccgtatgaatgcattaagtctaggagttgattgaaacctattcttgtgcatgatcctacctgatttagaggacatctttgccacttgttcactaattagtaactatcctatgcttagcaatgcttagatacttcaagcaacttggattgcttagctctaaggaaaattttggtcatacatgttagttaaggaaaaatagcctggaaattggaaatgcagacagaagctagagatggtagttctgtttgctaagttaatttggttaaggcccgatcgttgtcttaacctttgatcaagtgagttctacctggttgcttactgggtatgggaccagtaaagcccggtaggttagttggctctttgatcgggaatatttcgtacccgtgcttgacgtgctggagaatggtaggggcatagcctgaaactcacatggagatcaggccagacgtggggtcccatgtggggtgcgtccctgggttcgggtagtcatgttcccaatttttgggtacggctaatagaaaggtcattatatgcaacctagacagttgtacatagctggtggttgggtatctcctgcaggatgtaaattgatccggatcgccgcaattctcggatatgaatgcacttgatcaccgttaagcatcatactgtaatccagttgaatataatgtttttcctagaatgaatatgctgtatgacttagttccactgagtgctcaaaatgttttattcatctagactggttaggtaacaactaaacaaaaataaaagaataaagttaaggttccacttatagtaagcctttccgcaaaaatgtgagtccgccagtatactaaacagctatcattcagtttttggaaaaaaaaaactatctatattggttaatcgggtcagtcttgctaagtaccctcggactcaggggaatccttcgttgctatttcagaactacagcaagagtccgccgagggagaagccccgaagaattagggtatttttacgagtctcataataccctagaaataaaactcagatgtttaactttcacctggactagtttatgttttaaactcttagaactgttctgacctgcattgttaagtttgtttcaaattatggttgtaataattcgcacctcgatatgtatgtaaaaatgtaatatttgttgataccttcccatcgtggaagtgatcctgatgtatggctatggatcacgtcgtggatgtttcgaggagtcctaaggacactcgacggaataccggacttagactgttttaagtgcgtttcggataattgttgttctgatagcgattagacgcgcttaaaccagtttaagttgggcggttccgccacactatcccttattactgattttggtttggtttgggtccatccgagatgaagaagaggcaagcacatgtactggaataatattcctggatcgaaggtatgagcatcacacatttaaatgctagtattaagaagaggcaagcacatgtactggaataatatccgagatgcaagtttacaacaataactctggcattgcatcacctgctcaacccatgtccaatcacatgataatcctaccaaacttagcacgagctgaattaaaattttccttaatccgttttatatatgtacaaatgccaccattgccacataaatgcataagttcttcccagataattctataggccaccattgctattttataagaatccttcagaattttaagctgaaaggaacttgactaaaggaggaacaacaaggatagagtctagtgctccatcccatgctacagattttagttcagttttcaaccaacaagaattaaaatttattttctagcaaatgaaaattcaagggtcattttcttaaggtttgaagttataccattttgcatatatatcataagtatacaaactttagccatataatttttgctggccacaccttggctactttataaagaccctgcacaattttaagataaaagaaattcggcaaattaaagggagaaacaacaaggaacgagtcaggtgccccatcccatgtttccatcgagatgaagaaggggcaaagcacatgtacttgaatatattggatcgaaggtattatcagcatcaaatatttgaatacgagtagtattaataactttgagcagcgcggaaggttcttatggcctcagtgatagctaatctaactttacaatatctctgacattgcatcacatgctcatcccatgtcacatgataataatcctaccaagctcagcacgagccacatgaaatttcttaatcctttttttatatatatataaatgcaaaagattggatcagagcaagtagctaagtatcctgcatccctcttcatgtccatgaatcatatccccgatgaaccacataacctccttttattctttcaaaacaagttaaaaaattttgttctagaaaatgaatttttaactctggttttcttaaggtttgatttttttgcgtctatatataagttctttacagataactgtacctttgctagtttatatgaatcctgcagagtttcaaggtgaaatttaaggaacttggaagtgggagaaactgaggatcgagtccagtgctttatcggtttatcatcccatactaatgatttctttttgttcagttgcatgttgcaaccgggatgacgaatcgaatatgcaaatcacatgtacagggtttactggcatcttttttggatcgaaggtacgagcaccgcatttgaatatgagcactgacgttaagcttcgttagtgggtgaggttttgcactgtgtaaatttctctactcgtgattccagtgatctgcataatgtcaacggccgtataggagcaactactatttaagcatccattcgcccatctatttcgatcaacgctcact

SEQ ID NO: 398 - DNA, 1139 bp, Setaria italica
agtgctccatcccatgctacagattttagttcagttttcaaccaacaagaattaaaatttattttctagcaaatgaaaattcaagggtcattttcttaaggtttgaagttataccattttgcatatatatcataagtatacaaactttagccatataatttttgctggccacaccttggctactttataaagaccctgcacaattttaagataaaagaaattcggcaaattaaagggagaaacaacaaggaacgagtcaggtgccccatcccatgtttccatcgagatgaagaaggggcaaagcacatgtacttgaatatattggatcgaaggtattatcagcatcaaatatttgaatacgagtagtattaataactttgagcagcgcggaaggttcttatggcctcagtgatagctaatctaactttacaatatctctgacattgcatcacatgctcatcccatgtcacatgataataatcctaccaagctcagcacgagccacatgaaatttcttaatcctttttttatatatatataaatgcaaaagattggatcagagcaagtagctaagtatcctgcatccctcttcatgtccatgaatcatatccccgatgaaccacataacctccttttattctttcaaaacaagttaaaaaattttgttctagaaaatgaatttttaactctggttttcttaaggtttgatttttttgcgtctatatataagttctttacagataactgtacctttgctagtttatatgaatcctgcagagtttcaaggtgaaatttaaggaacttggaagtgggagaaactgaggatcgagtccagtgctttatcggtttatcatcccatactaatgatttctttttgttcagttgcatgttgcaaccgggatgacgaatcgaatatgcaaatcacatgtacagggtttactggcatcttttttggatcgaaggtacgagcaccgcatttgaatatgagcactgacgttaagcttcgttagtgggtgaggttttgcactgtgtaaatttctctactcgtgattccagtgatctgcataatgtcaacggccgtataggagcaactactatttaagcatccattcgcccatctatttcgatcaacgctcact

SEQ ID NO: 399 - DNA, 1140 bp, Setaria italica
agtgctccatccccatgctacagattttagttcagttttcaaccaacaagaattaaaatttattttctagcaaatgaaaattcaagggtcattttcttaaggtttgaagttataccattttgcatatatatcataagtatacaaactttagccatataatttttgctggccacaccttggctactttataaagaccctgcacaattttaagataaaagaaattcggcaaattaaagggagaaacaacaaggaacgagtcaggtgccccatcccatgtttccatcgagatgaagaaggggcaaagcacatgtacttgaatatattggatcgaaggtattatcagcatcaaatatttgaatacgagtagtattaataactttgagcagcgcggaaggttcttatggcctcagtgatagctaatctaactttacaatatctctgacattgcatcacatgctcatcccatgtcacatgataataatcctaccaagctcagcacgagccacatgaaatttcttaatcctttttttatatatatataaatgcaaaagattggatcagagcaagtagctaagtatcctgcatccctcttcatgtccatgaatcatatccccgatgaaccacataacctccttttattctttcaaaacaagttaaaaaattttgttctagaaaatgaatttttaactctggttttcttaaggtttgatttttttgcgtctatatataagttctttacagataactgtacctttgctagtttatatgaatcctgcagagtttcaaggtgaaatttaaggaacttggaagtgggagaaactgaggatcgagtccagtgctttatcggtttatcatcccatactaatgatttctttttgttcagttgcatgttgcaaccgggatgacgaatcgaatatgcaaatcacatgtacagggtttactggcatcttttttggatcgaaggtacgagcaccgcatttgaatatgagcactgacgttaagcttcgttagtgggtgaggttttgcactgtgtaaatttctctactcgtgattccagtgatctgcataatgtcaacggccgtataggagcaactactatttaagcatccattcgcccatctatttcgatcaacgctcact

SEQ ID NO: 400 - DNA, 1726 bp, Setaria italica
tggtaaaatcaattcatatgcttatacttcaaaaaccaatttatgtgtatatacttggaaaaattagattaagtatttcaatttatttgcttatatttcaaaaataaattcttgtgcatatacttagaaaaattagattaagtatttcaatttatttgcttatacttcaaaaatcaattcttgtgtatatacttacaaaaattagattaagtatttcaatttaattgcttatatttgaagtaagtcaattgtgcaaacccattgatctactatatatgtaataaactttgccaatgacacagatgatgtacaggaaagatagaatcttcaagtggatttcttctagacgaggtcataaatccagcgggggagtttcataatgatgcatcaaatctacagcaccgtcaggactcgggtttagaatagtagaaatgatatgtgtacgcacaatatgtctatatatatgtataatattattcatatatgtgtatgcataatatgtatatatataatagtatcttaaatgtaatattgaagataaatagaactttatatatattagcgtattagaagtagtatacgtatgaatatagaataaagaaaaagaaaataagaaaagaaaggaaaaaaacaaatcagtaccggtcggggagaccaaccggcactaattaggccctttagtgccctcccgccaccctctcctccctcttctctcgccgccctctcctccctctcagctcttcccgaccccttcctctcccactgccgccccctccctctctccgccgaccaccatcgtcctgcgtgatctccctctcctcaccctcggctgcccctcctctcccccttcgctcacccctcactcgtggcagtgaggagcagcggcaacacatagatccggtggtggcagtgcaggttccagtgaagaaggagctagcacggatccgacgaagaaggagctggttgcggtggcgtaggtgggcggccctggcggcgcggcctcagcttcctctccccgtacgcctctctctctctctctctatgagccggatccggtaggaccaaggcagttggcggctggtggggcggcaacggccagatccagcgagatgcggccggtcggatccggcgaggcagcgcaaggccggggcgtaaggcggccggcagcaccatttttttgtttttttaataggccttcaccgccagttccaaaaccagcggtgatggggtatccccatcactaccgaaagtcagacgatggatccaaaccgacggtgaagactggtttggagccggcagtgatgaacctctggagtagtgcttatggctgggggcattgacattctttttactaactttcttcctaccacgtagtatgcaataattgtacgtaatactagtagctgatgataagtttgatataagactatcaagcggtctcgacatttcacaatctcgtgcagcacatggacagctatactaacgagaagtcgaggacgacagcccaccgacttgacaaatctgtacaaaatatgctagaaaaatattgcaccaatcaaacattgcccatcaaggccaccaaggatacatgatgacaacggccaatcagacttcaaagatatctcaacatcatacacacagaaggaagagatgatgactccagtttaactttcatcgacgactcctataaatacgaccctcttcctgtacgcctcctcattccaac

SEQ ID NO: 401 - DNA, 1726 bp, Setaria italica
tggtaaaatcaattcatatgcttatacttcaaaaaccaatttatgtgtatatacttggaaaaattagattaagtatttcaatttatttgcttatatttcaaaaataaattcttgtgcatatacttagaaaaattagattaagtatttcaatttatttgcttatacttcaaaaatcaattcttgtgtatatacttacaaaaattagattaagtatttcaatttaattgcttatatttgaagtaagtcaattgtgcaaacccattgatctactatatatgtaataaactttgccaatgacacagatgatgtacaggaaagatagaatcttcaagtggatttcttctagacgaggtcataaatccagcgggggagtttcataatgatgcatcaaatctacagcaccgtcaggactcgggtttagaatagtagaaatgatatgtgtacgcacaatatgtctatatatatgtataatattattcatatatgtgtatgcataatatgtatatatataatagtatcttaaatgtaatattgaagataaatagaactttatatatattagcgtattagaagtagtatacgtatgaatatagaataaagaaaaagaaaataagaaaagaaaggaaaaaaacaaatcagtaccggtcggggagaccaaccggcactaattaggccctttagtgccctcccgccaccctctcctccctcttctctcgccgccctctcctccctctcagctcttcccgaccccttcctctcccactgccgccccctccctctctccgccgaccaccatcgtcctgcgtgatctccctctcctcaccctcggctgcccctcctctcccccctcgctcacccctcactcgtggcagtgaggagcagcggcaacacatagatccggtggtggcagtgcaggttccagtgaagaaggagctagcacggatccgacgaagaaggagctggttgcggtggcgtaggtgggcggccctggcggcgcggcctcagcttcctctccccgtacgcctctctctctctctctctatgagccggatccggtaggaccaaggcagttggcggctggtggggcggcaacggccagatccagcgagatgcggccggtcggatccggcgaggcagcgcaaggccggggcgtaaggcggccggcagcaccatttttttgtttttttaataggccttcaccgccagttccaaaaccagcggtgatggggtatccccatcactaccgaaagtcagacgatggatccaaaccgacggtgaagactggtttggagccggcagtgatgaacctctggagtagtgcttatggctgggggcattgacattctttttactaactttcttcctaccacgtagtatgcaataattgtacgtaatactagtagctgatgataagtttgatataagactatcaagcggtctcgacatttcacaatctcgtgcagcacatggacagctatactaacgagaagtcgaggacgacagcccaccgacttgacaaatctgtacaaaatatgctagaaaaatattgcaccaatcaaacattgcccatcaaggccaccaaggatacatgatgacaacggccaatcagacttcaaagatatctcaacatcatacacacagaaggaagagatgatgactccagtttaactttcatcgacgactcctataaatacgaccctcttcctgtacgcctcctcattccaac

SEQ ID NO: 402 - DNA, 1738 bp, Setaria italica
tggtaaaatcaattcatatgcttatacttcaaaaaccaatttatgtgtatatacttggaaaaattagattaagtatttcaatttatttgcttatatttcaaaaataaattcttgtgcatatacttagaaaaattagattaagtatttcaatttatttgcttatacttcaaaaatcaattcttgtgtacatacttagaaaaattagattaagtatttcaatttaattgcttatatttgaagtaagtcaattgtgcaaacccattgatctactatatatgcaataaactttgccaatgacacagatgatgtacaggaaagatagaatcttcaagtggatttcttctagacgaggtcataaatccagcgggggagtttcataatgatgcatcaaatctacagcaccgtcaggactcgggtttagaatagtagatatgatatgtgtacgcacaatatgtctatatatatgtataatattattcatatatgtgtatgcataatatgtatatatataatagtatcttaaatgtaatattgaagataaatagaactttatatatattagcgtattagaagtagtatacgtaagaatatagaataaagaaaagaaaataagaaaagaaaggaaaaaacaaatcagtaccggttggggagaccaaccggcactaattaggccctttagtgccttcccgccaccctctcctccctcttctctcgccgccctctcctccctctcagctcctcccgaccccttcctctcccactgtcgccccctccctctccccgccgaccaccatcgtcgtgcgtgatctccctctcctcaccctcggctgcccctcctctccccccttcgctcacccctcactcgtggcagtgaggagcggcggcggggtgagagcagcggcaacacatagatccggtggtggcggtgcaggttccagtgaagaaggagctagcacggatccgacgaagaaggagctggttgcggtggcgtaggtgggcggccctggcggcgcggcctcagcttcctctccccgtacgcctctctctctctctatgagccggatccggtaggaccaaggcagttggcggctggtggggcggcaacggccagatccagcgagatgctgccggtcggatccggcgaggcagcgcaaggccggggcgtaaggcggccggcagcaccatttttttgtttttttaacaggccttcaccgccagttccaaaaccagcggtgatggggtatccccatcactaccgaaagtcagacgatggatccaaaccgacggtgaagactggtttggagccggcagtgatgaacctctggagtagtgcttatggctgggggcattgacattctttttactaactttcttcctaccacgtagtatgcaataattgtacgtaatactagtagctgatgataagtttgatataagactatcaagcggtctcgacatttcacaatctcgtgcaacacatggacagctatactaacgagaagtcgagaacgacagcccaccgacttgacaaatctgtacaaaatatgctagaaaaatattgcaccaatcaaacattgcccatcaaggccaccaaggatacatgatgacaacggccaatcagacttcaaagatatctcaacatcatacacacagaaggaagagatgatgactccagtttaactttcatcgacgactcctataaatacgaccctcttcctgtacgcctcctcattccaac

SEQ ID NO: 403 - DNA, 3508 bp, Setaria italica
ttttgggacgcgagcagctttagagctgggatgacggcctctcttcgtgtgctcgaggcgttgcgtcaccctaggttttccctaggccagaggtaagatagttttgcctgcggcaacgcctttagtattggaaaccttggctgctttcttcaaggctttctgctccaaatgaagaatatttttcttcgatgcctcgcgaacgggggcctcgacgctgaagaaggaaaagacacgattcccccaggatccacccagcctcctttgaacctctttgtactccgaaggagattcggcaccaagaataaaatcaccacgatctttaaccttaatggaattgatctctacaaaatgaagcgcaggaaaagttatgtaacgaagagaaagcatgaagaaaaatcaatacagaggaggacaagcgtaaagtcttaatttctttggtaaacttgaaacatttcgaccaatccgggcaagggataggccctttggtatccagtccagtcggagtccagaattgcccagctacagcggacaggccacactccaagcatgcggtactcctcgataatatcgcaatgctatacttgcaggcaaagagacgaagcatcgagatgaaggcatcaccctcggcacatgcgggagggtcaatcttgtaatcatcatgaagagcctccatctttttagtgacgaggcagttgggctcaccagtctcttcaggctccacttcatgatagagctagtgttgatgccaatcgataggccacttgttgcgatatgcagccacggggttcaagactccagtgcgttacatgaagttgagacatccaaactgagcttgtttcccgaccactccattagcacttctctccaacaagtacttcagctggtgatgcaccttgtgagcattagtgaaactgactgccgaggacttgatttttgttgttttgcaaatccacatatacgtcgaaagatgaacgagagcgttgggtgtcaactgatgcaggtagatatcatacagacggagtatatctataacaattgggtccaactcaaaacgaagaccaacataaaggagatcacggaagatgacgaccttgttgtcttcgggtttcggaataacctcagaattgggtgcacggctagcaaagaccatcttgttctgcttcagtaagtcgatgtcattgggatgaagcaagcttcagccaaaaacaacagtctttggcataatctgatcaccatcgtcacccgaagggcggttgcattttggggccattgaatacaatgaagaacacaattaagcaaccaaaatgaagtcgtcggaagaataccaaacccagtgaagggggctttagacctccatcaaagaaagcgatagcggtaaaagtaaatggcacgagcccacacagggttatttataggtagagcgaaagagaaacagtaacaagggtcaaaagtcaaaaaaccattaaaaaaatttaatgaaggatttcgaataaggaaaaatatattaatcaaagggcaaggaagcaaaatcatgcatgggccgatcttggggagttccgaaggatggttgcaccatgtgttttaggatcgtaagttcagcccatcagaggagaagatggccctcgctcacgaggggctactattggggaaaccaccttgggaatctccttcgaagggagaagtccttttgacactaaccatgacagctagtttgctttgtggcgagctctaagtgcagggaagaagaaggcggtacgaagagctcttaggcgtatgagggctccttcggaacaaaacaatggctgactggcccgcgggtcttttgggagggccggcatctgactcgtcccctccaaggtttgtcctcagaggaaaggcatggagtggctcagcaaagagcacctcgacttccgaagatgaacatgcgttgaaagaccatgctgtccaccacatggattgaaaggaccgtacgaggagctagctggaggagtccatacaaaagatttgcacttgaagaaacccaatctgtagatcataaagccaacgtccttggaaaaaaccgagaaatgatacatggcctcatagaggtgaataattcgaaatcactatcaattcctccaagacatgattgcagaatgaggctaacagaatccacattgagagggatggaggatcgcccaaaagaagccaccaagaaaaactcattggaagagaaggcgtgtgagcaactgactggcaaagagaaactggattggatcatgcattggatctccaaacctagaccaaagtccagatcagagaggccacccatggtatggtagcctagaggaaggatcaccatgatcgccgaggaatggagagcacgacaccggggaggagggggacatcgccagtcaccatactcgcattcttttagcgtctgctcatctccacctaccctcccctagtcccctatctagttgcagtgcccaccactagatggtgccaccacgctaacctaaacgtcaagtctctccttccccggcaccgccccctatctagttgcaatgcccaccactagatggtgccaccacgctaacctaaacgtcaagtctctcctgccccagcaccgcccatcagcaatcgttgcctgcccacaagcacgacacgatggcacttatggaatcctcttaataccaacactactccaatccaaaaatttaacattgcagtttgattttgctctcgacctaaagaatcacaaaaattaatttaggtgtctggaatctatgaagtgcgagagagtaattaataaatcatgtatatatgtccagttgttgtttggggaaacctgtctctgtgcaaaagcagggtcctttgcccatgtacttttactatcagtcaacaaggcagcattctctcataaaaccacgaaagtaaaggaaccaagaccatcacagactccgtgcatgagttatgacatgtaaaggaaatcagccctggacaaattcaattgcagaagtccacagaagactccatgtgtgagtaatgacatgtaaagccaaatcagcctggacaaattccgttgcagaagaccacagtagactccatgtatgagttaagagtatatgacatgtagagcatatcagcgcctggacaaattcccttgcagaagtttctcgatccacctcagctagtcacgatgcaatcaccttactttagcaaaagcaaaacaaactgagatatgcagtcacatccttaataaactcgtcatactaccctcaccctattatcaaaagtaagaacaacaaaatacttttcccatgtaccccatgctgaatatcatggaggcgatcatgtgggtccaaaaacagttagggaaatctccaaatttgactagatgccatgtcacctccagcttatctaccctccaactttcagttctgcaaatgacaaaaaccttattgatctgcacggtgtttgtagcatataagcactataaataggacctagatgaatgctcagccca

SEQ ID NO: 404 - DNA, 1015 bp, Setaria italica
cgcgccaaacgtcaagtctctccttccccggcaccgccccctatctagttgcaatgcccaccactagatggtgccaccacgctaacctaaacgtcaagtctctcctgccccagcaccgcccatcagcaatcgttgcctgcccacaagcacgacacgatggcacttatggaatcctcttaataccaacactactccaatccaaaaatttaacattgcagtttgattttgctctcgacctaaagaatcacaaaaattaatttaggtgtctggaatctatgaagtgcgagagagtaattaataaatcatgtatatatgtccagttgttgtttggggaaacctgtctctgtgcaaaagcagggtcctttgcccatgtacttttactatcagtcaacaaggcagcattctctcataaaaccacgaaagtaaaggaaccaagaccatcacagactccgtgcatgagttatgacatgtaaaggaaatcagccctggacaaattcaattgcagaagtccacagaagactccatgtgtgagtaatgacatgtaaagccaaatcagcctggacaaattccgttgcagaagaccacagtagactccatgtatgagttaagagtatatgacatgtagagcatatcagcgcctggacaaattcccttgcagaagtttctcgatccacctcagctagtcacgatgcaatcaccttactttagcaaaagcaaaacaaactgagatatgcagtcacatccttaataaactcgtcatactaccctcaccctattatcaaaagtaagaacaacaaaatacttttcccatgtaccccatgctgaatatcatggaggcgatcatgtgggtccaaaaacagttagggaaatctccaaatttgactagatgccatgtcacctccagcttatctaccctccaactttcagttctgcaaatgacaaaaaccttattgatctgcacggtgtttgtagcatataagcactataaataggacctagatgaatgctcagccca

SEQ ID NO: 405 - DNA, 1009 bp, Setaria italica
aaacgtcaagtctctccttccccggcaccgccccctatctagttgcaatgcccaccactagatggtgccaccacgctaacctaaacgtcaagtctctcctgccccagcaccgcccatcagcaatcgttgcctgcccacaagcacgacacgatggcacttatggaatcctcttaataccaacactactccaatccaaaaatttaacattgcagtttgattttgctctcgacctaaagaatcacaaaaattaatttaggtgtctggaatctatgaagtgcgagagagtaattaataaatcatgtatatatgtccagttgttgtttggggaaacctgtctctgtgcaaaagcagggtcctttgcccatgtacttttactatcagtcaacaaggcagcattctctcataaaaccacgaaagtaaaggaaccaagaccatcacagactccgtgcatgagttatgacatgtaaaggaaatcagccctggacaaattcaattgcagaagtccacagaagactccatgtgtgagtaatgacatgtaaagccaaatcagcctggacaaattccgttgcagaagaccacagtagactccatgtatgagttaagagtatatgacatgtagagcatatcagcgcctggacaaattcccttgcagaagtttctcgatccacctcagctagtcacgatgcaatcaccttactttagcaaaagcaaaacaaactgagatatgcagtcacatccttaataaactcgtcatactaccctcaccctattatcaaaagtaagaacaacaaaatacttttcccatgtaccccatgctgaatatcatggaggcgatcatgtgggtccaaaaacagttagggaaatctccaaatttgactagatgccatgtcacctccagcttatctaccctccaactttcagttctgcaaatgacaaaaaccttattgatctgcacggtgtttgtagcatataagcactataaataggacctagatgaatgctcagccca

SEQ ID NO: 406 - DNA, 2162 bp, Setaria italica
aagctagcacagattatattgtccacctactctgcatagcatttacaaagattatgccttcactttgacgtgaaagaatgaaaactggcacatcttttggtacatggatcggaccacctagtctccttgaagcacgtctgtgtgtttttcttctttcgaagttctagcaatggaatgctgagggaaaagaagtacaagaatggagcttctgaaactttgataatttcttcaccaggaaactttggtaacttctcaaagatctagcaagggtctgccgaccgaaaaggagtccagatcgagccggagtctcgattcctgattggattggaaaagagacgacggacgccgagattgatcatatccctaacctagctctgcctctaagctacaaaggtcgagtgcgaggctaaccgccgcggatcgattgagtcctcatcgcaatgaagaaacacaaagcatcgagctcacggcgcgcggaggcgcaataatggggccgaagcgaaagcgacgacgattgctgcaactggccgcaacggcggcggcgacggggctccgacggcggtgaaggcggtggcattgccggtggagttcctcaggtggttcctggcgcagagcagcgaggactaccgcgtcccggccctcgacgactactcgccgtcgctgggacgccgccgaggagcgggagacgacggtccgccgggtgagcgccgacgtccaggccacgaagtatggcttcgccgcgttccatgcttgggtccgcggcgtcgccgacaaggacggccgcgtcgtgctcgggcgcacgtccaaccctcgggagctgcaggagatcatcgacggcgagtgggcagaagcgaggtgggagctcggcatgggggatggagatggagttgtcgccggttctgatgacgctgccggcaaggaggacggtgagggcgccatggcgtcgtcgtcgtcatcgtccaagatgatgagggtcccacgcggcccgcatctgcaaaccctgtcgatctacctgtctctgatctaccagcgcatgacataagtttttggttagggtcgttcatgtcacgtatatccatgtcgtatctaacttaggcagtctcggtgggagtttcctgaagagtttcatggtcaataaattccatactacatgagcaattttgctgacttggtaaggtcgtaaagtaagatctttacgaggagattccattggcatccaaaatcccctacttgagtgaagtggttatgctcggagttaccttcacgcttcatgatatttgtatttcttaatatatacttaaaaatggactgtctactggtaacccaggtgttattctggccacaatcacccgggtgatttgtaggggaataacaccccggttttgaagtggaaaaaaaatccaggtgctgcaaagagatctgtcacctgaaagttctgaacctaagattctgatcagacgattaacaaaaaagattatataaacaaggaaaagcaaaatagctgaacatattttttctatggtcagccaaagaacaaataattctgggttagtggaaactctaaagatgcaaacacagcatgcaaatttacacagatttaaaattacgcaatatacaaattgaaattacagtaacaatatcactgtaagttacttactgtatagtgtaaatcattaagaatcctaatgtatatgattaagaatcctaatgaatatggaatactaaagttagttactaatataatgtataacgaaaggagagaggcaggagagatccttggcaggcaggcagagggtttgaatgaggagcaggtccggtcgtcagaccgcaaactgctgccaaaaaattaaatgcgctgcgatctcgcaaagataggatagcaccccccaccgctgtgtctactggtactccgactcgcaattatcacggggcggcgtacccgccgcctgcagaaaagaagcccaactttgatttggatcagaacggaggaaaaaaaacagatcgtcagatcggacggtgccaaattcaggtgacaggagctcgtgaatcacccaagcaacgtatagcttttccccttaaaaaagtatgtcaacctatgtacgatgtagagttactagtcgtgacgaaacaaacatttaccaaacacacttgagcagatagat

SEQ ID NO: 407 - DNA, 2161 bp, Setaria italica; identical to SEQ ID NO: 50

SEQ ID NO: 408 - DNA, 1899 bp, Setaria italica
ctgaagattcctgtgggaaaccaactgatgtagtttctaaggaaacagagttgaagaagagtgtttgctcaagctagacctattaatcaatggttttgtcatgtcacagtcttctgtctcaggaacgaacactgcaccaattcagcagttgctgagctttagcaacacacgtgaagtggaatctcaatgtgctctgagagtctgagtttcacaatgagaagaaagaagtgaataagggatgtggagtaggagtatgcagtcattcatcaatggctggcactatagctggcatgttggttcctgatttacatctacagagacacatcaaactaagtttgacactatgtttgactaaatcagaagccaacctcatccgaatttaactgttggtagtattcccaccatctttggcatgaatttgctgccaaagttatatttatcatgtacgtgaacagattatatcactgattttatggtcattggcagggatgattggatcatttcaaagatgcaattttttctccttgtgacattattcacattagtcccagacatgatcaattggagtacagtaggaaaatgattctttgtacagaatttaccatcatctgtaatagacagtataacagatgcttccagtgatatgtccagatccaaggtttgcatgtgttagaaaacaccatgcacagcatcttggtgatagtggaactttttgtttgtattagtattatatctcccccctacaaaatgacaaaatgtttgtatacgcactggccgtttgcgtttgtatgcacgtatttctccaaactctgatagttacagcagtccatccaatttagttttatgcagtctgaaatccttttcatatacatttatgtgcttgcaaacattctgtagctgtccagcttttgtgattcaattgcaagatccctttcattttcatcgtactttgtttctttccttttcattgagatctttaggtgctatgaagccaatttgctccctggtaccaaagtttattgcaagaggcagaatttcattttcttcctttttgcccttcagtatttcagaactatttttactatgcaagatatgatatttgtaccttctttcttctcccagttggtctgttaatgtcagagcactttgtaaggccatgaggggggaatatgctgctgtatggttggaatcctgttggtggcatttttggcagggagttgttcaaattagtggtggatgtccgctgcaagcctgcaactggactccagaagcagcagcatattctcaggagcaaggatgtgtgtcaaagaaggaaccctgcatgcaacaaacaacggacggctggaggttgatgtgtgttaaagaaggaaccctgcatgcagcaaacaacggacggctggacgttgttatcaccaaaatactggctgtaaaatcttgtgttttttcgggaataactggcaacgggacaatttcatggatgcagtatatcagggcatctccgccgttggaagacacgtatgggctacagttcttggtgaaatccacccatagaaacccagaagccaggatccatcttaaggccaagaatgcgcagacaatattcaacggaccacgttgcacaaagaggaaaatgtttcttttgccagttttacatggtacacagaaaagagaggagaaataaagtatctgccagagccaggacaaaagagagggtggcaagaggattgcaggaatccagaaggctagcctccacctcacaattcatatctcttgtccttgtgtgcctccagttgcgcaaccttatatgccagccggtgcaacacttctcaagcccctaaggaaagattgtgtgtcaaggaaaggatagtgcttgtctccttgtgttcaggaccagaagca

SEQ ID NO: 409 - DNA, 1998 bp, Setaria italica
ctgtcactgtctcatttgcatcaccactagctcgatcactagattcagagaacacgcgcaaccgaacgagctgaggcaaagatgcatgaacagaggcatacatgtcccgtgccaagcagctggaacaagcatcccgtcgccccaggttctcatgatctgatctgccatccctgcagctgcagccatcgtctcctggcccagccaaacccccttgacgaatcgaggtaggtcgctcacatggacctcgtgcagtgaatgggattcaaggatcctccgaaccgatcgctgcaagtggttgcaggagggagagagaggggcctaaaagagggggcagaaaggagctgcgcgcgttgccaatccgagcgagatgcccgaaacgaggcgggtgaaaacccaggggagatcaggacgagatcgtgttgggagcgcgtccaaatcatcggagatcgccgaggggtcgtcgaggggagaacctactgtgaagaaagctcgtgcgctttgtcctggctcgctgagattgttttggtcggccccagcctcactccccagatgtggaaactgaacactggggctccattattgtgccctctgtatagaaaccttggcaggccaggggaccagattaggtgctcctttcctttgctttgttcattcatctgtgaacactgaacacaaatgttattctcttctgatcctctggtgagtttacatgtggaggcaggttttctttgctgatgcaaactggcttttgttcgttggataggattccaagcgatacactttcgaggcagttctttgcgctgagctaacatgttgttttctagtttcagcctttcaggacaactatgcttgtaggatatatcatgggtcatggccgaccatcccttggcaagcttcacatttatgctggcctaaaaggaggctcttgtaaaattatttcacaacagtttaaaagttcaacgaaatgataatacagtttcaacaataagctcaaaacatccagtgatttttttaatgtatatataataaggaatgcaagaaaaacattataataggttgacttggctagagaactatccatggtgtttactgatcggtggtgcatgtccatcatgcagactggcagtttccaacgagaagttcagttcatgcagccgttcaagagggcctttgctcctgctatcgtgggcggctactcctccccctgcaacctcggaggagacagcgggtgtgattcgagagaaccgggagcaaagtggagcgaggattagggcggcgggttagctggccggggcgaacggagaggaacaagattcgatccactgccctgcgccaccccctgtgttctcgctctagatctccccgctcccgagactcccggccaccgcccggccggctcacaccacgccactcgcggacacgctgctcctctcggctcccacctataaatacgcccctgctcatggcgctcccctctcagccacatgtgtcctcgatttggtagcttgcaagaaccctgctgcgaccccgtgttgcgttgattcctcctcctcctctctcgagatcctggcagggagtcgatccccggccggttgcgaaatcggtggttgaattgctcttcactgctctcggggtttgttgtctttgagcggtggctctggaatagtctgtttctgttcttgttccttctcatctctcccttgatgcatttctccttcttggactcgtagaggtatctgtccacatcgaccacaaaattgatcttgcggcctctctctagcttatgcggttctgaattctgcctgttcttcattgatttgttctgtgcggtcactcttcagtcttcactgtcttgagttcatgaagctgggaactccaggcatatcagcccgcatttacttgttgaatccgtttctccttctgtgacgggagaagaagaaagaacccccggcagaactctcgtctcaattcgattggttagatgcaaagagatggtgc

SEQ ID NO: 410 - DNA, 1998 bp, Setaria italica
tggaaatgaaattgtagaatgatgtgaaataatagtatataaaaaacagaaaaaaaataggcccggagtacttgctttacgcatctgttagatgatcgatgaggcattcatgtcacgatctttagggatgagtgttcagtttggctattttaccttttatgaaatacaataatatatcacatacaaaccgctaatatttggaattctataaagtgagcaattttcaggtctgtcagacttgcatcaccactcaaagttcgtcaacctgtcaggcaaactcctgaagatttccaaatactctgccaaacatcattgcagcaggaatgcagtagaagaaacacattgtgcgtgatattattcgttcgcgtttggcaataatttttgcttgaagcattgcattggtcgaaatagatgtgccatcatgagtacgaaacctgaaattattctacctgaaactaactatgctaccagttcagatagaaattgtgacaacactcaacatgaagttccgctgcttgcatcgcatcggcattgtaggcattcaacattcgatggagcagagagaaatcaggagcagccgacattgttgccagctttgccatcaggagcagggagataacgcggcaatgctggtcgtgcgtgccaccccgtggacggcccttccttggtctactccagcacggtgcccttcgccgctgcctggtacgaaacaaggaggacaagaaggacctcgcgcaatgagtcgccattgcaggctaacgcggtgaatttgccccgtcgcatttccgacggggacggtgtacgctggatggatgacgacggcgccgaccgcgtccgctgcggcacggtatgactgatagaagtttgcatattgattattgattattaatcatgatccgcaggcaccgacgacggccgtgcacctcccgccgccatcctctagcgagtagagtggcaggcggagtctccagcagctcagatggatcttgcgatggtgtagatgccgctgccgccgcccccagtgcacgtgcgagtgattggaaatgaagagacaaggagtaaaaggaaagaagataaggataattaagaaagatttgatatatttcaacaatatcattttacacattctccaatcatacctttatactatctatactactcatgcatactacctatactacaacttaaggttttagcagtatacaattaatctcaaccgtcggacccttacatatgagtcattttcgaatagtagtataaggtagtattgtgtaccgtaaaatacctctccaaatttcccaccagaagagcagcaggatgttcctcatccctttttaaatctgttatttctgtgtccaaaacccattcttgagtttattccaattgcattgtgccaaatatcatgttaatgtttttttaagtagcaaaagagggaggcatatcatgatatcaatatatcttaatgaggcatattgaataccaaagcatccacaaattgcagacctaaatcttgtgctaccaattccagttcattgatggagcatgatcgagtaatcttttcagctcagtttaggagaaagctaagcacaactccttgtatggtttaaaatagttacacttttttacttttcatggttttcctatattcaatatttaaaaacctcacaaaccacctctttgttgcagttcgtcaaaatggcaatgtttagtttctacaggatggtttcaattggcataattaaagatgctagagtctgagtgtctgaccatcgaaacgtcatgtggttgatttccaaatgaccagatcacacaaattttagacagtggagtgcaagtctacaacactccaatctccaaactcacaccctttgtgcctcattccgtttcagttattctcgcagcgcaccttgaagcttccctaacgcatgactccgttctctcccaggcctccctaaaaccatgccaagaactcccgaaaaggctttctagttcacagaa

SEQ ID NO: 411 - DNA, 2144 bp, Setaria italica
actatagggcacgcgtggtcgacggcccgggctggtatcggcgaccgctaagagaagacatttaaaataagtagtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttagcgatcaagttaattttgtttctgctttgtgcgcctgtgttccagtaa

SEQ ID NO: 412 - DNA, 612 bp, Setaria italica
accgcggaggagtagggcaggtggcgctggagattggagggcaaaccgggaagcgcgggatggagggaggcgaagcggacgacgtgggggaggctcgcggacgctgaatcgatcggagggtaaactaggaagtgcaggctggagggaggcgaagctgacggtggggggtggttcgcggacgcggaaccgagtggaggaacccagacctaggaagttttttttcaccttttttggttttttcgagtccagatagtaagtatgttgttgtatacttttctcatccaagcaacccctttcaggatccaaattaaagaacttgagctatgtccccgccatatgatcttctctgtcccttttctttaggaatataaaaacatactcgctaatcatgagattatactttaatcacgacattatacttttctttaggaatataaaaacatagtcgctaatcacgagattatactttaatcctatatatggtccccgccacatgatcttatctgtcccttctctttaggaatataaaaacattggtagccaccagcatcagagctgctctctgtatttaattactatatcgtagccaccagcagagctgctcaatccgca

SEQ ID NO: 413 - DNA, 603 bp, Setaria italica; identical to SEQ ID NO: 34

SEQ ID NO: 414 - DNA, 1005 bp, Setaria italica; identical to SEQ ID NO: 54

SEQ ID NO: 415 - DNA, 2201 bp, Setaria italica
actgaccttttggatgcggccttgcttcgtcttcttcacgaatgacttgctctgcagcatggtggaaagcgacggcgtgccgcgaggcggcggcgaggagactggaggagacgtgtaccagccggcggcgaggtggaggcggaggcggcggcggcgaggggtgtcggggtttaattgggtttggtactttggtgggtgcgtgttgggtcggttgcctcagatttggttccgacccgtccgagtcccccgtccggaaggccccaaggctggactcgtgaaacatcatcgagctaggcggcccaataggcaatctaccattttgcaggtttttccatagaacacaaaaacaaatggccacttcaccgtttgatcctaaaaaacatagtcttccgagtttggttcggtcaaaaaaaatcagctatgcaattgaaccggtgcgacctagcaggttttagggtgaactagtagaccatgaaccggttttatgttgaaccaatgattagtttgcatattttgcatataatataatgagaaatgataactattaaattgataaataaaaaacctggttcgatcggtaaaccaatgaacaagttacatgaacagttcctctggtccggcttttggttagcgttttttttttctcatgcgccaaatgtgaattaagagtctttgcacttgtctactcgatggacatcttgtaatagatggaattttgtatgtttgtgttcttttttgttttgtaaggattttatggttgtattaagtagattgtactcatttcaatgagcaaaatgtaggaatggttctatatttacccaacaatgtcactgaggttcctgaattattaatatgcgtgtttgccctaaacttagtaacttactaagtgattcacttaaggttcaaatatgaatgatgtgttgatctgactacttagcatccatgtggcatccctgttatccaacctttttttttacaactcattgttcatatttcccttagcccatatgacaaccaaaggaaaaataaaaaattctattataaatttgcaacccgcatttactccatttcaataagcatcataaaagacgtgatatagttggcataagataaaagagagtatgcaaatatgatttgtacatggcgtgcaacgcaatgagttatcataaatcaacaaaaacaaaatgaaaatgattggaaaactatttgaagttctatgtgtttcgtgtgatactagctcacttcagatgtttccctctctccaccactgttggccaacattctaccttagcctatatcgctctctcatcatccaatgttaagcgttattcacactaacttggtcacggtgataggccaccataaaaaaccggcctctgttctacaatttttgtgaaccttttgattgtaccttagcgattgagcattgctgcacttacagagggaatggtacaaataaagatgagtaatatgactagtgtttctcgtaatacctcaatgtagccagtcactccaaacttctatggggagttggggaacatttgagatatagacgatgtaagcgtgaaagggaaaagaagaaaaaaaaattccctcgttgaagaaaatgggaattcacgcaaaaagaagaaaacgggaattcgcgcaattgaccccaaagaaaacaaatgcctagtaggtgccaccgaaaaaagatgaatgaccaccaccaatgtgagaaaccaacaacgtagggtgacgaacgatcacacaaacgagtccatcttatagcctgtccgccatgcacaaataccgatcactcgatcaaacatatctgcccgttaatagtggccccaaaagcacggatcacacaggacacacaaaaaggcccgtcgcccccgatcaaaatgacaaaaaagatcagccccgagcttcatgttccctctcgctgtgacccacaggctccgctagcacgcggacaacaactcgaacggcaggaacagtgacgcacagcgccagccgccaggatatttgcagctctcctgccggcaccagcacacaccacacatcggatatcgccccgccgaacgggtggctgcggcgcatgcaatcgccttatcctacgcccggcgcccccgaggccgccccgaggccacaagcacaaagaagtgatcacggcgccacgaccccccggccggccggcagcacataaattgggagca

SEQ ID NO: 416 - DNA, 1902 bp, Setaria italica
ccaataggcaatctaccattttgcaggtttttccatagaacacaaaaacaaatggccacttcaccgtttgatcctaaaaaacatagtcttccgagtttggttcggtcaaaaaaaatcagctatgcaattgaaccggtgcgacctagcaggttttagggtgaactagtagaccatgaaccggttttatgttgaaccaatgattagtttgcatattttgcatataatataatgagaaatgataactattaaattgataaataaaaaacctggttcgatcggtaaaccaatgaacaagttacatgaacagttcctctggtccggcttttggttagcgttttttttttctcatgcgccaaatgtgaattaagagtctttgcacttgtctactcgatggacatcttgtaatagatggaattttgtatgtttgtgttcttttttgttttgtaaggattttatggttgtattaagtagattgtactcatttcaatgagcaaaatgtaggaatggttctatatttacccaacaatgtcactgaggttcctgaattattaatatgcgtgtttgccctaaacttagtaacttactaagtgattcacttaaggttcaaatatgaatgatgtgttgatctgactacttagcatccatgtggcatccctgttatccaacctttttttttacaactcattgttcatatttcccttagcccatatgacaaccaaaggaaaaataaaaaattctattataaatttgcaacccgcatttactccatttcaataagcatcataaaagacgtgatatagttggcataagataaaagagagtatgcaaatatgatttgtacatggcgtgcaacgcaatgagttatcataaatcaacaaaaacaaaatgaaaatgattggaaaactatttgaagttctatgtgtttcgtgtgatactagctcacttcagatgtttccctctctccaccactgttggccaacattctaccttagcctatatcgctctctcatcatccaatgttaagcgttattcacactaacttggtcacggtgataggccaccataaaaaaccggcctctgttctacaatttttgtgaaccttttgattgtaccttagcgattgagcattgctgcacttacagagggaatggtacaaataaagatgagtaatatgactagtgtttctcgtaatacctcaatgtagccagtcactccaaacttctatggggagttggggaacatttgagatatagacgatgtaagcgtgaaagggaaaagaagaaaaaaaaattccctcgttgaagaaaatgggaattcacgcaaaaagaagaaaacgggaattcgcgcaattgaccccaaagaaaacaaatgcctagtaggtgccaccgaaaaaagatgaatgaccaccaccaatgtgagaaaccaacaacgtagggtgacgaacgatcacacaaacgagtccatcttatagcctgtccgccatgcacaaataccgatcactcgatcaaacatatctgcccgttaatagtggccccaaaagcacggatcacacaggacacacaaaaaggcccgtcgcccccgatcaaaatgacaaaaaagatcagccccgagcttcatgttccctctcgctgtgacccacaggctccgctagcacgcggacaacaactcgaacggcaggaacagtgacgcacagcgccagccgccaggatatttgcagctctcctgccggcaccagcacacaccacacatcggatatcgccccgccgaacgggtggctgcggcgcatgcaatcgccttatcctacgcccggcgcccccgaggccgccccgaggccacaagcacaaagaagtgatcacggcgccacgaccccccggccggccggcagcacataaattgggagca

SEQ ID NO: 417 - DNA, 2200 bp, Setaria italica
actgaccttttggatgcggccttgcttcgtcttcttcacgaatgacttgctctgcagcatggtggaaagcgacggcgtgccgcgaggcggcggcgaggagactggaggagacgtgtaccagccggcggcgaggtggaggcggaggcggcggcggcgaggggtgtcggggtttaattgggtttggtactttggtgggtgcgtgttgggtcggttgcctcagatttggttccgacccgtccgagtcccccgtccggaaggccccaaggctggactcgtgaaacatcatcgagctaggcggcccaataggcaatctaccattttgcaggtttttccatagaacacaaaaacaaatggccacttcaccgtttgatcctaaaaaacatagtcttccgagtttggttcggtcaaaaaaaatcagctatgcaattgaaccggtgcgacctagcaggttttagggtgaactagtagaccatgaaccggttttatgttgaaccaatgattagtttgcatattttgcatataatataatgagaaatgataactattaaattgataaataaaaaacctggttcgatcggtaaaccaatgaacaagttacatgaacagttcctctggtccggcttttggttagcgtttttttttctcatgcgccaaatgtgaattaagagtctttgcacttgtctactcgatggacatcttgtaatagatggaattttgtatgtttgtgttcttttttgttttgtaaggattttatggttgtattaagtagattgtactcatttcaatgagcaaaatgtaggaatggttctatatttacccaacaatgtcactgaggttcctgaattattaatatgcgtgtttgccctaaacttagtaacttactaagtgattcacttaaggttcaaatatgaatgatgtgttgatctgactacttagcatccatgtggcatccctgttatccaacctttttttttacaactcattgttcatatttcccttagcccatatgacaaccaaaggaaaaataaaaaattctattataaatttgcaacccgcatttactccatttcaataagcatcataaaagacgtgatatagttggcataagataaaagagagtatgcaaatatgatttgtacatggcgtgcaacgcaatgagttatcataaatcaacaaaaacaaaatgaaaatgattggaaaactatttgaagttctatgtgtttcgtgtgatactagctcacttcagatgtttccctctctccaccactgttggccaacattctaccttagcctatatcgctctctcatcatccaatgttaagcgttattcacactaacttggtcacggtgataggccaccataaaaaaccggcctctgttctacaatttttgtgaaccttttgattgtaccttagcgattgagcattgctgcacttacagagggaatggtacaaataaagatgagtaatatgactagtgtttctcgtaatacctcaatgtagccagtcactccaaacttctatggggagttggggaacatttgagatatagacgatgtaagcgtgaaagggaaaagaagaaaaaaaaattccctcgttgaagaaaatgggaattcacgcaaaaagaagaaaacgggaattcgcgcaattgaccccaaagaaaacaaatgcctagtaggtgccaccgaaaaaagatgaatgaccaccaccaatgtgagaaaccaacaacgtagggtgacgaacgatcacacaaacgagtccatcttatagcctgtccgccatgcacaaataccgatcactcgatcaaacatatctgcccgttaatagtggccccaaaagcacggatcacacaggacacacaaaaaggcccgtcgcccccgatcaaaatgacaaaaaagatcagccccgagcttcatgttccctctcgctgtgacccacaggctccgctagcacgcggacaacaactcgaacggcaggaacagtgacgcacagcgccagccgccaggatatttgcagctctcctgccggcaccagcacacaccacacatcggatatcgccccgccgaacgggtggctgcggcgcatgcaatcgccttatcctacgcccggcgcccccgaggccgccccgaggccacaagcacaaagaagtgatcacggcgccacgaccccccggccggccggcagcacataaattgggagca

SEQ ID NO: 418 - DNA, 2352 bp, Setaria italica
gaattcgcccttactatagggcacgcgtggtcgacggcccgggctggtatcgttgttcgttcgtgtaccgacatgagcatgtgcaagtacactgatccatgttggtgccttgcgcgaatagaagcaagcggcgagctcggaacgtaatgcgacgagcttgcaaggagcagcatcttctaccactgcaagggatgcaagtctggattgttttggatcgacccaaaaactcattaaaacaaactaatcttgatttcaaagaagggagagtggggataaaaatgaactaattaaccagccagcctactactgcatacctactagtgtcaccacttggatgttggaactagcaactgtgctgtgtgttgtggatgcgaccgttgcacagcactagctgacccggtgaaagtaaaaatcctgtggagaatggctccaagcagccagcggaggccgacgcttgtccacgtctctctcaaccggaaaataaggggggaaagatcctgagaactggaggccagtgtgagctgcttcggcttagccgcttactacacgttgccaaaaggccagcgcggatggccacaactccaaatcctcgcccagctccgcctcacgctcccgccatcctgttcacaacacgacggcctcacaatttctttttctttttcttttttgcaggagctctgctatgctatgtaaagaggaaaagcaattcaaaatcttacaaagtcgatattgcataaatattagagctcacactactcaagttagaagctaaactcatgggtttggacgcctcacaaatttgggaggcgactggtgagtaacccacccaccaatcgcgagggcaccctctcatcaaaacaacgttggtgtttcttttttttttttactaaatggcaggagctctaccttattaataagaaaagattaaaagagtttaaagatcacaagcaaacggcacgccgctgcaaccgcccaagagtgcttcggcagacacatgtcgagtgttataaaaagagctatgtgatctaagttagggaacaaaacgttcgtctatattgctctatgcattcctttgttcgttttgccacctgatgggccgttagaagcttgttttcaaaaattctcctgttaccctctttccacatattccacaaaatgtagatggacatttcgttgaaatcttactgctgatttttgtggatatatacttttccaccgcctcccaccaatctctgacgttgtcgaaatttgaggggtgtgcttgctaaggaagcccacaaatatctctcatatagaaacttggttctagaccgcttgagcatatgggcggagtaggaagaggtgttgcccggattccattggcccattgcataatgcgcaagaggttttggtgcggccatcctctaagtgcgaggttgcctgtcgtgagaattttagtttggatgacaatccagacgaacagcttacatttattttcagtgcgggcacgccaaatgagattggctttgtgacatctatgtgacccaaaaaactgagcaccatatgctgattgggtggagtatttgccatcagccgtccacttccaagtattcgtatcctccgcctctaggtatgtcctgcaatctgatccgagtgagacaaactcctcaacttgagttgtagtcgtattttgttatgcaaggatttgatccacgtgctgttccatagctcttgtgccattgtcttgttttttcttctcaccagatcatataaatgtggccctaaattccttggtgcctcgccatcaagccaaactatggtgccaacacctcgccttctttccgttcgacgtccaacaatggtgccaaaaacaacgttggcgtttcacgtccaactggtagtggcagcacggactctgccgaaatagaacaccgaatatccatcaacattgctttcagggtctcgttgcaacacctgaggcctccaagcacctccagcccagcagcactagtcttctgctctctgtaacaaaaaaaaaaaataccagcaccacgccgcgaaaggtcaccccgagaatcaaccgacgaaacgagaggggaggaagaaaggtcacaagtcacaactcacaaacagaaggggtcgggggcatgcacggagaaaaggccacgcatcgatgagcgtaacagtgaaggttgtgggtgacgcggccagccatcggcaaccatacgttgggctatccaaaatctcatccctcaaccaatcccgacctcacgatcccgcgccgcgcccccgcgcaccacaaacgcggccaccccaatccgccaactcgtatatacacgccgcttgttggctagcatcgtcaccttgatcgat

SEQ ID NO: 419 - DNA, 2307 bp, Setaria italica
atcgttgttcgttcgtgtaccgacatgagcatgtgcaagtacactgatccatgttggtgccttgcgcgaatagaagcaagcggcgagctcggaacgtaatgcgacgagcttgcaaggagcagcatcttctaccactgcaagggatgcaagtctggattgttttggatcgacccaaaaactcattaaaacaaactaatcttgatttcaaagaagggagagtggggataaaaatgaactaattaaccagccagcctactactgcatacctactagtgtcaccacttggatgttggaactagcaactgtgctgtgtgttgtggatgcgaccgttgcacagcactagctgacccggtgaaagtaaaaatcctgtggagaatggctccaagcagccagcggaggccgacgcttgtccacgtctctctcaaccggaaaataaggggggaaagatcctgagaactggaggccagtgtgagctgcttcggcttagccgcttactacacgttgccaaaaggccagcgcggatggccacaactccaaatcctcgcccagctccgcctcacgctcccgccatcctgttcacaacacgacggcctcacaatttctttttctttttcttttttgcaggagctctgctatgctatgtaaagaggaaaagcaattcaaaatcttacaaagtcgatattgcataaatattagagctcacactactcaagttagaagctaaactcatgggtttggacgcctcacaaatttgggaggcgactggtgagtaacccacccaccaatcgcgagggcaccctctcatcaaaacaacgttggtgtttcttttttttttttactaaatggcaggagctctaccttattaataagaaaagattaaaagagtttaaagatcacaagcaaacggcacgccgctgcaaccgcccaagagtgcttcggcagacacatgtcgagtgttataaaaagagctatgtgatctaagttagggaacaaaacgttcgtctatattgctctatgcattcctttgttcgttttgccacctgatgggccgttagaagcttgttttcaaaaattctcctgttaccctctttccacatattccacaaaatgtagatggacatttcgttgaaatcttactgctgatttttgtggatatatacttttccaccgcctcccaccaatctctgacgttgtcgaaatttgaggggtgtgcttgctaaggaagcccacaaatatctctcatatagaaacttggttctagaccgcttgagcatatgggcggagtaggaagaggtgttgcccggattccattggcccattgcataatgcgcaagaggttttggtgcggccatcctctaagtgcgaggttgcctgtcgtgagaattttagtttggatgacaatccagacgaacagcttacatttattttcagtgcgggcacgccaaatgagattggctttgtgacatctatgtgacccaaaaaactgagcaccatatgctgattgggtggagtatttgccatcagccgtccacttccaagtattcgtatcctccgcctctaggtatgtcctgcaatctgatccgagtgagacaaactcctcaacttgagttgtagtcgtattttgttatgcaaggatttgatccacgtgctgttccatagctcttgtgccattgtcttgttttttcttctcaccagatcatataaatgtggccctaaattccttggtgcctcgccatcaagccaaactatggtgccaacacctcgccttctttccgttcgacgtccaacaatggtgccaaaaacaacgttggcgtttcacgtccaactggtagtggcagcacggactctgccgaaatagaacaccgaatatccatcaacattgctttcagggtctcgttgcaacacctgaggcctccaagcacctccagcccagcagcactagtcttctgctctctgtaacaaaaaaaaaaaaaaataccagcaccacgccgcgaaaggtcaccccgagaatcaaccgacgaaacgagaggggaggaagaaaggtcacaagtcacaactcacaaacagaaggggtcgggggcatgcacggagaaaaggccacgcatcgatgagcgtaacagtgaaggttgtgggtgacgcggccagccatcggcaaccatacgttgggctatccaaaatctcatccctcaaccaatcccgacctcacgatcccgcgccgcgcccccgcgcaccacaaacgcggccaccccaatccgccaactcgtatatacacgccgcttgttggctagcatcgtcaccttgatcgat

SEQ ID NO: 420 - DNA, 1810 bp, Setaria italica
gggcaaggatgatggattgcttttgagaatgacttcttaaagcgtcaagcttttctgactgtgtcaggtcagcttcaggttgaaacttatgcttgtgctctcagtagtgtatatacctttggaccaacgttccgggcagagaactcacatacatcaagacatctggcagagttttggatggttgaaccagaaaatgcatttgcaaacttgcaggtgagctgcttcttgatgactaactttattactttgtggttcgccacctatcaaattggatcatggggttttgtgtggacataactaatgttaaacttgtataaattgtgtcacaggatgatatgaactgtgcagaaaaatatgtacaatacctctgccagtggttactcgatcattgtgaagaagacatagatttcattagcaaaaaatacgagagaaacagtagacataatcaaactgcaattgaccgtctgaagcttgtttcctcaacgcattttgaacgtatttcatacacaatggctgtggacattctgaaaaatacagaacaaggttgaatggggaatcgatttagcatctgagcatgaaaggtatgtgcaagttgtcagttgatcttactggtcttcacctgatttaccttctttgattggttaactgtaactacgtattctgtgaaggtatttgactgaggtgatatataagaagccagttattgtttataactatcccaaagaaataaaagcattttatatgaggctcaatgatgatcagaagactgtttctgctatggatgttcttgcgccacaggtatagatcgaattgttgaaatgtctatgatgctgtccattgttcactgaagtgccccacaccattctaccctcaatcagcatggatataagcagccagattcatgtctgctcttagtagaatataactatttctttctgccttttagaatttagatatctctggattcttttttcgccttttcaccaattacaaagaactaaaactgcatataactatattaagataacaatatttacattttctgaaatagctgtatgcttgcaactacatgctggatattttgctttgcctgctttgtatatagtttgaaagtgagctttgtggccgatgatttctacctaaccataaattattttccttggtaggttggtgaattgactggtggaagccagaggagcatctagatgtcctgaaacagaggtaccgacttgctcaatataattttgtttctatcaggatcaatattaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcatcgttgatatctcttgcagcgttgggtctctgtcacacacacaggaagcacaggaagctaagctagcagtcgcgagagagcgagcgatggcgcggcccaaggtgtacgggtgggcgatctcgcc

SEQ ID NO: 421 - DNA, 1766 bp, Setaria italica
ggatgatggattgcttttgagaatgacttcttaaagcgtcaagcttttctgactgtgtcaggtcagcttcaggttgaaacttatgcttgtgctctcagtagtgtatatacctttggaccaacgttccgggcagagaactcacatacatcaagacatctggcagagttttggatggttgaaccagaaaatgcatttgcaaacttgcaggtgagctgcttcttgatgactaactttattactttgtggttcgccacctatcaaattggatcatggggttttgtgtggacataactaatgttaaacttgtataaattgtgtcacaggatgatatgaactgtgcagaaaaatatgtacaatacctctgccagtggttactcgatcattgtgaagaagacatagatttcattagcaaaaaatacgagagaaacagtagacataatcaaactgcaattgaccgtctgaagcttgtttcctcaacgcattttgaacgtatttcatacacaatggctgtggacattctgaaaaatacagaacaaggttgaatggggaatcgatttagcatctgagcatgaaaggtatgtgcaagttgtcagttgatcttactggtcttcacctgatttaccttctttgattggttaactgtaactacgtattctgtgaaggtatttgactgaggtgatatataagaagccagttattgtttataactatcccaaagaaataaaagcattttatatgaggctcaatgatgatcagaagactgtttctgctatggatgttcttgcgccacaggtatagatcgaattgttgaaatgtctatgatgctgtccattgttcactgaagtgccccacaccattctaccctcaatcagcatggatataagcagccagattcatgtctgctcttagtagaatataactatttctttctgccttttagaatttagatatctctggattcttttttcgccttttcaccaattacaaagaactaaaactgcatataactatattaagataacaatatttacattttctgaaatagctgtatgcttgcaactacatgctggatattttgctttgcctgctttgtatatagtttgaaagtgagctttgtggccgatgatttctacctaaccataaattattttccttggtaggttggtgaattgactggtggaagccagaggagcatctagatgtcctgaaacagaggtaccgacttgctcaatataattttgtttctatcaggatcaatattaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcatcgttgatatctcttgcagcgttgggtctctgtcacacacacaggaagcacaggaagctaagctagcagtcgcgagagagcgagcg

SEQ ID NO: 422 - DNA, 518 bp, Setaria italica
caggatcaatattaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcatcgttgatatctcttgcagcgttgggtctctgtcacacacacaggaagcacaggaagctaagctagcagtcgcgagagagcgagcg

SEQ ID NO: 423 - DNA, 513 bp, Setaria italica
caggatttaggtttcatttgctcgtcggtggaggtagcaagcagttttgtccatcattggttcacgaatatttgctgaacattgtccaatatttgttctacagaattttggatgcgggattgcccatcacccctgatgcgagctagtctgcttcatggcgaggcggtgacctcgacgtgcagggtgccagggtagagtgcccatcacccctgacgcgagctagtctgcttacgcaagcagcgacgtcacaagtgtagtaaaaggcctcgttgacccacgaccaatccaccgcttcctctagcaccttcttccccgagcaccggcaggcagcagcgagatctaggcagcagccatcgctcctcttctcccccctgctcctgtataaatagcagcaggcaggggcaaccaattccatcaactcgtatcatcgttgatatctcttgcagcgttgggtctctgtcacacacacaggaagcacaggaagctaagctagcagtcgcgagagagcgagcg

SEQ ID NO: 424 - DNA, 1002 bp, Setaria italica
ctttgcttcacagctagtatcgtataagcgcttgatcactaataataacaactccgatcccggcgtttaattacggcaatcgatgttgatggatcttttggttgtcgtgctgctagctgttcacgtttcagagatcagtttagtcaaatgcaatgcataggtaaggcatccacagtcatttgctgaaggtctaatctgcatactcatttggtaagcatgcacttagcaattaagtatttattatgaaatggtctatccataaaatttctaccatttttcaagttccaataaaggagcataatccaacaatgttacaatgtcatatataatatttgctcggctgctacttgaaatggcatgtgtaataggtgtttgagcttgtaagctaactgctgccccttccgttgcaaaacatatacatatatatagttctcaaatataattgtcctatatgcacacataagagaaccaatttaataagtgaaatttgagcaataattatggaattgtgctatggagctcattattagacacaaaagttcaacattcaagtaattcacaccagtaaattaaaagcagtgaaaacgtattgagaaccttaatatttcgatggatggttcttccttcattactttttaaaatgatgaatataaaactaatacattgataaaactgcttaaatcagagaaatcaagtaggtcagtttcaagggggccttctagacacctatgatcatattacctttgatgccctagattctccaatgatccatgaagatgccttcaaagcagctaaaattaatcaaagcaccagataggataggaaaacaagtacagagacaatttgttattacatcgcttcttgcatatagtgtagccaagtcaaggtgctccactgatccattggcttttaaaaatctccacttgatcttctactgaaccactagctactgcatggcctcatcaaggtactataaatagacatgctgctttcactcaaact

SEQ ID NO: 425 - DNA, 316 bp, Setaria italica
aacacaaagagccagtcatcctggtcaggtcgttttaggatcagaaataaagtgcgggaaggaaaaagaaaaagaaaactctagccctactcccattttgtggtaggcaagctacaattttgttcccttgttcagaacaggggtgtgcattcaattccttgcttcctcccattcccccatcccatctcctctcccctgctccgccgaagcagcaagccagcctggttcccccaacacccacagccatcacctcctccccccaatccggcaatcccccactatgaatctgatcccccaagaagcccccgcttccaat

SEQ ID NO: 426 - DNA, 1279 bp, Setaria italica
ccaccgatcatcacacacagccagtagtgggggtgggccaagcaatcaggcacccggcaatgcgagctgatgcgtgatgatggtgctaccaacaaactgactataaaatttctgatttgaaagggattggcctcgatattttattagctccccggcttttgtcacgacacgttagcatgcgtgccttctagaagctagtccgggtattaccgctagaaagttcccgaaatgaagcatttaccacccgtaaagctcatttttctttatgatgagtagacacggtaccaacattgaggaccgattggttggctcccaaaatctgccctgccaaactagggcaagttcataaattttgacattcgcttggttggcaatcaattaaatcctattctaaaattcttgcctaggttttgatataacatgccctatattttggtctactcaaattttggtatggtaaattttgaacaccaacaaatcaggctattatttatcttatctctttctcaatttcattacacagcaaggcagtaattaaaaggaccgtatatacaatggatgtaagaataaaatgtataagtagaaatatattggcatgcctcgtgctggtgcatgtcgatatgctctcaattagaagttggagacaggttatgcttaggatagtcccaacctatgatatctgtgtgtctatactgccacataagtaagacatcactttagaaattacattctacaacctataatttcttagtgtggatccttaattaattcatcatctctcctctcaattcctcatcaattatgaagacaccatcttcttccaatgcaaatttaacactgtctaggatctaggttcaggtgttgatactgggtcttgcatgagatccagtttcttgttcttccaattctctctcatttaatatataatcacataagcaaaagatcctatgtagctgcacaattaatgctatggaaactatcctaatcggagggttgggactgctcctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacg

SEQ ID NO: 427 - DNA, 1470 bp, Setaria italica
gaagagtcggcgatgccgctgaacatgatcttggcgatcgggcacgcggcgtacgtgaagggggaggaggaggccggcttcgggatcgacccggccaagggggtggacgcaagcgagctgtacccggacgttaagtacaccaccgtcgacgagtacctcaacaggttcctctgaaggacgagacgagaacaatatgcaccttgtaattttcatcatttttggtaatttaaattgtcaaggattggtgatctaagtcgacaagggatgatgtgtcaatataagatcacgatcaatagtaagatgcgtcaagaaccggaatagcacgcgagcgatttatacaggttcagaccccattatttgagtataagagttttttctattaccgtgagcacaaacaatttggtatttaggtcaagatgcaacccaaaagcccaaatgcttatgtgtcttgtacatcgccccatgatgcgtacatataccgatcgagaaccacttttgttgtcgtagtcggttatgaactcctactcgtatacaagtagatcaattcgtcgggatgatgtgtatgctaataagactcgacagtacgaacttgatcttgaattgagcaatctaaaaccttcctttgacgcttatttcattatcatcactcatcattagcccccaagctctatccagaattccaaattaggctgagcggatctggccaaattttgcttttgccgaccatggactcggccacagttgacgggaagttaccttagttgaagtcgcctgactactaaacattatcaaattttgccatttttgttgatgaactctactcaatgttgtctttgttagtggaatatataatttcccagtgcagaggagagaaagaaatgaaaaaaatgaccactgctttaggcataaaattggtccaactctaaccacatccaagttcaagaaaaaaataaaaagagcatccactccccgtccgtgtccacaagcccacaatggtaatttaaaatttctcttcatgcaccgatttctcttttttatttcttcttacataaatttttgttcatccccagatttccaaccgtgttgtaaaaatatcccgatatcgctaacacaacggaggcggaggagacagaaaatctcgctagaattggtgatagggcgaagagaaaaattttgaagtgggtggaagagagcaagatactcgggcacaatatagcaattccgaaaaagtaggccaaacacaaatgtcgtcatccttgaacaatgacgacaccaaggtttcggcccataatgtccaagtccggaaacacaaccaggttcacgcttcaccacaaccatcagtcgacgaaacaaaatatcgatggaaccagctgtgaatgtgatactcgattagaccattatatacgctggcgctggatgccaatcagacgccaagcgagtttctgaggttctgtcgtgtagtaacacagg

SEQ ID NO: 428 - DNA, 620 bp, Setaria italica
aaaatttctcttcatgcaccgatttctcttttttatttcttcttacataaatttttgttcatccccagatttccaaccgtgttgtaaaaatatcccgatatcgctaacacaacggaggcggaggagacagaaaatctcgctagaattggtgatagggcgaagagaaaaattttgaagtgggtggaagagagcaagatactcgggcacaatatagcaattccgaaaaagtaggccaaacacaaatgtcgtcatccttgaacaatgacgacaccaaggtttcggcccataatgtccaagtccggaaacacaaccaggttcacgcttcaccacaaccatcagtcgacgaaacaaaatatcgatggaaccagctgtgaatgtgatactcgattagaccattatatacgctggcgctggatgccaatcagacgccaagcgagtttctgaggttctgtcgtgtagtaacacaggatggcgtcggagaagagcaagatcctggtggtcggcgccaccgggtacctgggcaggcacgtcgtggcggcgagcgcgcggctgggccacccgaccttcgcgctcgtcagggacacggcgccgtccaatccggccaaggcggcgctgatcaa

SEQ ID NO: 429 - DNA, 1272 bp, Setaria italica
ccttgtaattttcatcatttttggtaatttaaattgtcaaggattggtgatctaagtcgacaagggatgatgtgtcaatataagatcacgatcaatagtaagatgcgtcaagaaccggaatagcacgcgagcgatttatacaggttcagaccccattatttgagtataagagttttttctattaccgtgagcacaaacaatttggtatttaggtcaagatgcaacccaaaagcccaaatgcttatgtgtcttgtacatcgccccatgatgcgtacatataccgatcgagaaccacttttgttgtcgtagtcggttatgaactcctactcgtatacaagtagatcaattcgtcgggatgatgtgtatgctaataagactcgacagtacgaacttgatcttgaattgagcaatctaaaaccttcctttgacgcttatttcattatcatcactcatcattagcccccaagctctatccagaattccaaattaggctgagcggatctggccaaattttgcttttgccgaccatggactcggccacagttgacgggaagttaccttagttgaagtcgcctgactactaaacattatcaaattttgccatttttgttgatgaactctactcaatgttgtctttgttagtggaatatataatttcccagtgcagaggagagaaagaaatgaaaaaaatgaccactgctttaggcataaaattggtccaactctaaccacatccaagttcaagaaaaaaataaaaagagcatccactccccgtccgtgtccacaagcccacaatggtaatttaaaatttctcttcatgcaccgatttctcttttttatttcttcttacataaatttttgttcatccccagatttccaaccgtgttgtaaaaatatcccgatatcgctaacacaacggaggcggaggagacagaaaatctcgctagaattggtgatagggcgaagagaaaaattttgaagtgggtggaagagagcaagatactcgggcacaatatagcaattccgaaaaagtaggccaaacacaaatgtcgtcatccttgaacaatgacgacaccaaggtttcggcccataatgtccaagtccggaaacacaaccaggttcacgcttcaccacaaccatcagtcgacgaaacaaaatatcgatggaaccagctgtgaatgtgatactcgattagaccattatatacgctggcgctggatgccaatcagacgccaagcgagtttctgaggttctgtcgtgtagtaacacagg

SEQ ID NO: 430 - DNA, 1236 bp, Setaria italica
ccttgtaattttcatcatttttggtaatttaaattgtcaaggattggtgatctaagtcgacaagggatgatgtgtcaatataagatcacgatcaatagtaagatgcgtcaagaaccggaatagcacgcgagcgatttatacaggttcagaccccattatttgagtataagagttttttctattaccgtgagcacaaacaatttggtatttaggtcaagatgcaacccaaaagcccaaatgcttatgtgtcttgtacatcgccccatgatgcgtacatataccgatcgagaaccacttttgttgtcgtagtcggttatgaactcctactcgtatacaagtagatcaattcgtcgggatgatgtgtatgctaataagactcgacagtacgaacttgatcttgaattgagcaatctaaaaccttcctttgacgcttatttcattatcatcactcatcattagcccccaagctctatccagaattccaaattaggctgagcggatctggccaaattttgcttttgccgaccatggactcggccacagttgacgggaagttaccttagttgaagtcgcctgactactaaacattatcaaattttgccatttttgttgatgaactctactcaatgttgtctttgttagtggaatatataatttcccagtgcagaggagagaaagaaatgaaaaaaatgaccactgctttaggcataaaattggtccaactctaaccacatccaagttcaagaaaaaaataaaaagagcatccactccccgtccgtgtccacaagcccacaatggtaatttaaaatttctcttcatgcaccgatttctcttttttatttcttcttacataaatttttgttcatccccagatttccaaccgtgttgtaaaaatatcccgatatcgctaacacaacggaggcggaggagacagaaaatctcgctagaattggtgatagggcgaagagaaaaattttgaagtgggtggaagagagcaagatactcgggcacaatatagcaattccgaaaaagtaggccaaacacaaatgtcgtcatccttgaacaatgacgacaccaaggtttcggcccataatgtccaagtccggaaacacaaccaggttcacgcttcaccacaaccatcagtcgacgaaacaaaatatcgatggaaccagctgtgaatgtgatactcgattagaccattatatacgctggcgctggatgccaatcagacgccaa

SEQ ID NO: 431 - DNA, 1090 bp, Setaria italica
ctgaagagtcggcgatgccgctgaacatgatcttggcgatcgggcacgcggcgtacgtgaagggggaggaggaggccggcttcgggatcgacccggccaagggggtggacgcaagcgagctgtacccggacgttaagtacaccaccgtcgacgagtacctcaacaggttcctctgaaggacgagacgagaacaatatgcaccttgtaattttcatcatttttggtaatttaaattgtcaaggattggtgatctaagtcgacaagggatgatgtgtcaatataagatcacgatcaatagtaagatgcgtcaagaaccggaatagcacgcgagcgatttatacaggttcagaccccattatttgagtataagagttttttctattaccgtgagcacaaacaatttggtatttaggtcaagatgcaacccaaaagcccaaatgcttatgtgtcttgtacatcgccccatgatgcgtacatataccgatcgagaaccacttttgttgtcgtagtcggttatgaactcctactcgtatacaagtagatcaattcgtcgggatgatgtgtatgctaataagactcgacagtacgaacttgatcttgaattgagcaatctaaaaccttcctttgacgcttatttcattatcatcactcatcattagcccccaagctctatccagaattccaaattaggctgagcggatctggccaaattttgcttttgccgaccatggactcggccacagttgacgggaagttaccttagttgaagtcgcctgactactaaacattatcaaattttgccatttttgttgatgaactctactcaatgttgtctttgttagtggaatatataatttcccagtgcagaggagagaaagaaatgaaaaaaatgaccactgctttaggcataaaattggtccaactctaaccacatccaagttcaagaaaaaaataaaaagagcatccactccccgtccgtgtccacaagcccacaatggtaatttaaaatttctcttcatgcaccgatttctcttttttatttcttcttacataaatttttgttcatccccagatttccaaccgtgttgta

SEQ ID NO: 432 - DNA, 1412 bp, Setaria italica
aaatttgggtgtgaataaggtttgtctatacctcgagtggtgggtccactgacaacagcacgagaacaaggtatccaccgatcatcacacacagccagtagtgggggtgggccaagcaatcaggcacccggcaatgcgagctgatgcgtgatgatggtgctaccaacaaactgactataaaatttctgatttgaaagggattggcctcgatattttattagctccccggcttttgtcacgacacgttagcatgcgtgccttctagaagctagtccgggtattaccgctagaaagttcccgaaatgaagcatttaccacccgtaaagctcatttttctttatgatgagtagacacggtaccaacattgaggaccgattggttggctcccaaaatctgccctgccaaactagggcaagttcataaattttgacattcgcttggttggcaatcaattaaatcctattctaaaattcttgcctaggttttgatataacatgccctatattttggtctactcaaattttggtatggtaaattttgaacaccaacaaatcaggctattatttatcttatctctttctcaatttcattacacagcaaggcagtaattaaaaggaccgtatatacaatggatgtaagaataaaatgtataagtagaaatatattggcatgcctcgtgctggtgcatgtcgatatgctctcaattagaagttggagacaggttatgcttaggatagtcccaacctatgatatctgtgtgtctatactgccacataagtaagacatcactttagaaattacattctacaacctataatttcttagtgtggatccttaattaattcatcatctctcctctcaattcctcatcaattatgaagacaccatcttcttccaatgcaaatttaacactgtctaggatctaggttcaggtgttgatactgggtcttgcatgagatccagtttcttgttcttccaattctctctcatttaatatataatcacataagcaaaagatcctatgtagctgcacaattaatgctatggaaactatcctaatcggagggttgggactgctcctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacgagatttgcagcgcacactgagcgagtacttggcaggccgatcagctcgttgatagcaag

SEQ ID NO: 433 - DNA, 1365 bp, Setaria italica
ccaccgatcatcacacacagccagtagtgggggtgggccaagcaatcaggcacccggcaatgcgagctgatgcgtgatgatggtgctaccaacaaactgactataaaatttctgatttgaaagggattggcctcgatattttattagctccccggcttttgtcacgacacgttagcatgcgtgccttctagaagctagtccgggtattaccgctagaaagttcccgaaatgaagcatttaccacccgtaaagctcatttttctttatgatgagtagacacggtaccaacattgaggaccgattggttggctcccaaaatctgccctgccaaactagggcaagttcataaattttgacattcgcttggttggcaatcaattaaatcctattctaaaattcttgcctaggttttgatataacatgccctatattttggtctactcaaattttggtatggtaaattttgaacaccaacaaatcaggctattatttatcttatctctttctcaatttcattacacagcaaggcagtaattaaaaggaccgtatatacaatggatgtaagaataaaatgtataagtagaaatatattggcatgcctcgtgctggtgcatgtcgatatgctctcaattagaagttggagacaggttatgcttaggatagtcccaacctatgatatctgtgtgtctatactgccacataagtaagacatcactttagaaattacattctacaacctataatttcttagtgtggatccttaattaattcatcatctctcctctcaattcctcatcaattatgaagacaccatcttcttccaatgcaaatttaacactgtctaggatctaggttcaggtgttgatactgggtcttgcatgagatccagtttcttgttcttccaattctctctcatttaatatataatcacataagcaaaagatcctatgtagctgcacaattaatgctatggaaactatcctaatcggagggttgggactgctcctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacgagatttgcagcgcacactgagcgagtacttggcaggccgatcagctcgttgatagcaagctcactcgtcagtaagtagcaatcagg

SEQ ID NO: 434 - DNA, 361 bp, Setaria italica
cctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacgagatttgcagcgcacactgagcgagtacttggcaggccgatcagctcgttgatagcaagctcactcgtcagtaagtagcaatcagg

SEQ ID NO: 435 - DNA, 1293 bp, Setaria italica
ccaccgatcatcacacacagccagtagtgggggtgggccaagcaatcaggcacccggcaatgcgagctgatgcgtgatgatggtgctaccaacaaactgactataaaatttctgatttgaaagggattggcctcgatattttattagctccccggcttttgtcacgacacgttagcatgcgtgccttctagaagctagtccgggtattaccgctagaaagttcccgaaatgaagcatttaccacccgtaaagctcatttttctttatgatgagtagacacggtaccaacattgaggaccgattggttggctcccaaaatctgccctgccaaactagggcaagttcataaattttgacattcgcttggttggcaatcaattaaatcctattctaaaattcttgcctaggttttgatataacatgccctatattttggtctactcaaattttggtatggtaaattttgaacaccaacaaatcaggctattatttatcttatctctttctcaatttcattacacagcaaggcagtaattaaaaggaccgtatatacaatggatgtaagaataaaatgtataagtagaaatatattggcatgcctcgtgctggtgcatgtcgatatgctctcaattagaagttggagacaggttatgcttaggatagtcccaacctatgatatctgtgtgtctatactgccacataagtaagacatcactttagaaattacattctacaacctataatttcttagtgtggatccttaattaattcatcatctctcctctcaattcctcatcaattatgaagacaccatcttcttccaatgcaaatttaacactgtctaggatctaggttcaggtgttgatactgggtcttgcatgagatccagtttcttgttcttccaattctctctcatttaatatataatcacataagcaaaagatcctatgtagctgcacaattaatgctatggaaactatcctaatcggagggttgggactgctcctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacgagatttgcagcgca

SEQ ID NO: 436 - DNA, 289 bp, Setaria italica
cctgcctatggcggcttattccccatttgcctaacctgaaaatcgaaagggagtgcatgacagggcaaacactagtgttgcctgcatcaataatcgtccatgattatatagaggtagcatgacttttttaggcgtcgtgtcctaatcaatcagaaaagaaagccaacctaatcgctatgggccgcaaccaccgatgcgactatgcgagtatatggaacccgttgctactcccccactatatatcgtggagtctgatggcaatccaacggcagacgagatttgcagcgca

SEQ ID NO: 437 - DNA, 669 bp, Setaria italica
tagcctccgaatattcgatgtggcatgaattttagtccggactaaagatccaaacaccccttaatttcttgggttttggatattcctcaacttgaaccatcatagattacatagtccaagcttcttcctcaaatttttgtttttgtccataattttaagctagcgaactcattaaccaactacccctagcttacgaaagttgggatgacacaaaaacatggtggaaatccttaggaatgaataaaggacattttttggtccgtgcaaaagtgtgacttgtacttgaaggaaaattattggacctaaaaatagtttaaaaaaatgtgacactagctcgagagaagcaagcgaccaatagggattgtccaaccagatagggtgatactatagagtctatagagacgaagcgaaagcagatataggctggtggaatggaaagggatgttaatcctgccgagggtgtaactaatggaaaatttcttgtatttttcgtaatccatgctttggattacacagcaggccaaaacgagtgacaacacgtcactaatagttgttgatggttgcccatttaagtaaaaaaggttacagatcaccaaaccaaatatcaccgcaaaataattggccctataaataggctgcccggcctgcataacaatcgtgccttgctgt

SEQ ID NO: 438 - DNA, 1760 bp, Setaria italica
ccgctgctcaaaacaagtcaacgttgtggaggttctacaagattgagaggagtactaggcatacgttttctccggtcaactgcctgtggagtcaccgtgcttgttgaagatccgcagcgataataataaaattttgtgctattgggtttaaaagactatcggtcaggatatactctctttacgttatgacattgactatgatattcactaaagttgtcgcatgtgtgtaatttgatcctaacgcacatgtaatttatgcatggtggttttacctttaaaactggggtgtaacattttaacactattttaatatatttaacacagtaggggcctcctctactgtatttaccttaaaaaaaagataacaaaaaacgcatgcattgagtaagcagaaatgctaaaatggcgtgaagaagaggtatagtctcacaaatctttgtccaaatggactaatggtctaaaaaaaagtgaaaatgaaccttagatttcctggagaattaacaaaaaagaaactttgatgccaataacgattttcctccgggagagactatgcagggcacttgctgctccgtttctttcaacaatgaattccgttgggaaccgtttcatgcaagttgcgcatttctttgaggttgtggctgacatagagtttagggtactaaataatcattggtttggccaatagattaaaaataataattcaactgtgctagaaactagagttaatacctttttcattgcttgcatgagaaaccctatccaattttgtacagtactgacgtccgcgttaggatggaactggtgtaagattgacttttattaatcggaactctatacaattcactgttttttgtgcaagaatttgaatacaactggtacaagcaatgtatgcaatcttaagctgtgcgatgatgtatccagtttaagcaatgagttggcatcacgatctgaaagaaagattcaaacagataaggttttcatcaaattcagtgcatattgtgcaagaaatttgaatccaactctttcaaggaacttaatcaattcaaagatgtgcaatagggaaccacttcacacaatgaactggcatcacagcctgaaagaaaggtttgaacagataaggatttgataaaattcaatgcatgttgtacaaaaagaatctgaattcaattcttgcaagaaacgtattcaacttaaatatgtgcaatgatgcatgtatttaagcaaggtatcacatcacagtctgcaagcaagaatttaaaaagctaaggatttcaccaaactttatgcaaactgtgcaggaagtcatattcgattcgttcaagaaacatcacaatcagaaaagcaagatttgaaccggccagcagggaacttatccgctgcgtaccatttatacaactttattcagattcaaatgaaaaaattgcaacttttgtaagtatataagcatctctgctataaaaaatatgttaagttactgttaataaagtcaaattgaccgggcaaacaattggatttcttttaattcatgcaagcttttccagtagcaacataacctttatcttgctcttgagaaagaaaaaacacatgtaaaaactggcaacgttggagtactggtattttcctgcactatttcagccaagtggccaaccaatagcgtcacggcatgtaaatgcctcagacgccatgcagttgtttgattgcctctcaaccactataaattgggggcacatatgccctctcctcggcaattgctctgtgct

SEQ ID NO: 439 - DNA, 936 bp, Setaria italica
cggaactctatacaattcactgttttttgtgcaagaatttgaatacaactggtacaagcaatgtatgcaatcttaagctgtgcgatgatgtatccagtttaagcaatgagttggcatcacgatctgaaagaaagattcaaacagataaggttttcatcaaattcagtgcatattgtgcaagaaatttgaatccaactctttcaaggaacttaatcaattcaaagatgtgcaatagggaaccacttcacacaatgaactggcatcacagcctgaaagaaaggtttgaacagataaggatttgataaaattcaatgcatgttgtacaaaaagaatctgaattcaattcttgcaagaaacgtattcaacttaaatatgtgcaatgatgcatgtatttaagcaaggtatcacatcacagtctgcaagcaagaatttaaaaagctaaggatttcaccaaactttatgcaaactgtgcaggaagtcatattcgattcgttcaagaaacatcacaatcagaaaagcaagatttgaaccggccagcagggaacttatccgctgcgtaccatttatacaactttattcagattcaaatgaaaaaattgcaacttttgtaagtatataagcatctctgctataaaaaatatgttaagttactgttaataaagtcaaattgaccgggcaaacaattggatttcttttaattcatgcaagcttttccagtagcaacataacctttatcttgctcttgagaaagaaaaaacacatgtaaaaactggcaacgttggagtactggtattttcctgcactatttcagccaagtggccaaccaatagcgtcacggcatgtaaatgcctcagacgccatgcagttgtttgattgcctctcaaccactataaattgggggcacatatgccctctcctcggcaattgctctgtgct

SEQ ID NO: 440 - DNA, 483 bp, Setaria italica
taaggaaataataaaagaagaaactacttgtttttgcaatgataacgtacatacagatatttctaaagccatcaagtacctagcttgtctaaataacaagtgtgtcctggaacaagtatcgagtacctgaaagcaacctgctttgaattggaaaggataaaaattcgacaaggaacgaacaaaggaggcacatttcttgccggccagaaactattgggtctttgcatccttgtgaattgataaacgtgctggtgtgtttcaatgatgtccatgagatgggaatacaaagtcaagcacgccttattaccttattgtgtggctctgtctgcagaaagcaaccgggcgcattttcttccgataccgtggttactttcaaattggaagacagagacgtacacacaaggcaataattcagggaacaattccatccatccactgctataaaaggcggtgttggggtgttgggtctcttcagttcagtgt

SEQ ID NO: 441 - DNA, 1516 bp, Setaria italica
cctcttcctttatttttgccatcagcgtcgttgttgaactctcgtgcctgttaaagatgtgtgtgttccgctctttccaaatttcccatataatgagtagagtgagactttgcatagccttgcgcggtaagtccagtattgtagttatagaagtccatcattccaatgcattggatgagggttgccatgcagttggtctgatgcttggctgcgctaaccatgttgccgttaaatcccatatcctccttgtgttcctgcacttagcctagatgtggtgactagtttccatggtttgtctgcatagggtgcaagtggcgttgtatggccatccacgtttagcctgcctatccacggaccaaactcagttttgtgtaattagccgcaagaagaatttgcattttgccggcgcccacgttttccagacagaagagatttctggtgtttcgatgcagcccaggaactgtgctttatatgccgatgctattgtatacatgacggatcttgttagtttctagaagatagtatcctcttccacttatcgaagctcctgaccatagcccatagggcgaacgatgctagatgctaaatgtgaagtggtgatgctgttgtcgatattgaggtcacagatccagttgttactgatagcatcgtgaactgtcctattttgtcttcttgaaatgtcgaagaggagtggagcaatgtccttaggtgctggccatgtagctagccagaagtccagaagctagcctttttgccatcaccaagagtgataaccatgcaggcaacaaatacttgcatgtctgtctcgtcgcatgggatttctatgttggtccagggtttttccggtgatgcctactcatgccaaagccacctcagacggagggctcgtgcgaatttctcgaggtcagcccctcgtattgcttcagtaggcaggttttcgtccagttgactttacatttaccctcggttagctgttggtctcccgctcagaggaattttttacggatcttgtctaagtcttggagcccctctttaaggaaataataaaagaagaaactacttgtttttgcaatgataacgtacatacagatatttctaaagccatcaagtacctagcttgtctaaataacaagtgtgtcctggaacaagtatcgagtacctgaaagcaacctgctttgaattggaaaggataaaaattcgacaaggaacgaacaaaggaggcacatttcttgccggccagaaactattgggtctttgcatccttgtgaattgataaacgtgctggtgtgtttcaatgatgtccatgagatgggaatacaaagtcaagcacgccttattaccttattgtgtggctctgtctgcagaaagcaaccgggcgcattttcttccgataccgtggttactttcaaattggaagacagagacgtacacacaaggcaataattcagggaacaattccatccatccactgctataaaaggcggtgttggggtgttgggtctcttcagttcagtgt

SEQ ID NO: 442 - DNA, 170 bp, Setaria italica
gtgtggctctgtctgcagaaagcaaccgggcgcattttcttccgataccgtggttactttcaaattggaagacagagacgtacacacaaggcaataattcagggaacaattccatccatccactgctataaaaggcggtgttggggtgttgggtctcttcagttcagtgt

SEQ ID NO: 443 - DNA, 1524 bp, Setaria italica
cctcttcctttatttttgccatcagcgtcgttgttgaactctcgtgcctgttaaagatgtgtgtgttccgctctttccaaatttcccatataatgagtagagtgagactttgcatagccttgcgcggtaagtccagtattgtagttatagaagtccatcattccaatgcattggatgagggttgccatgcagttggtctgatgcttggctgcgctaaccatgttgccgttaaatcccatatcctccttgtgttcctgcacttagcctagatgtggtgactagtttccatggtttgtctgcatagggtgcaagtggcgttgtatggccatccacgtttagcctgcctatccacggaccaaactcagttttgtgtaattagccgcaagaagaatttgcattttgccggcgcccacgttttccagacagaagagatttctggtgtttcgatgcagcccaggaactgtgctttatatgccgatgctattgtatacatgacggatcttgttagtttctagaagatagtatcctcttccacttatcgaagctcctgaccatagcccatagggcgaacgatgctagatgctaaatgtgaagtggtgatgctgttgtcgatattgaggtcacagatccagttgttactgatagcatcgtgaactgtcctattttgtcttcttgaaatgtcgaagaggagtggagcaatgtccttaggtgctggccatgtagctagccagaagtccagaagctagcctttttgccatcaccaagagtgataaccatgcaggcaacaaatacttgcatgtctgtctcgtcgcatgggatttctatgttggtccagggtttttccggtgatgcctactcatgccaaagccacctcagacggagggctcgtgcgaatttctcgaggtcagcccctcgtattgcttcagtaggcaggttttcgtccagttgactttacatttaccctcggttagctgttggtctcccgctcagaggaattttttacggatcttgtctaagtcttggagcccctctttaaggaaataataaaagaagaaactacttgtttttgcaatgataacgtacatacagatatttctaaagccatcaagtacctagcttgtctaaataacaagtgtgtcctggaacaagtatcgagtacctgaaagcaacctgctttgaattggaaaggataaaaattcgacaaggaacgaacaaaggaggcacatttcttgccggccagaaactattgggtctttgcatccttgtgaattgataaacgtgctggtgtgtttcaatgatgtccatgagatgggaatacaaagtcaagcacgccttattaccttattgtgtggctctgtctgcagaaagcaaccgggcgcattttcttccgataccgtggttactttcaaattggaagacagagacgtacacacaaggcaataattcagggaacaattccatccatccactgctataaaaggcggtgttggggtgttgggtctcttcagttcagtgtgctcaagc

SEQ ID NO: 444 - DNA, 491 bp, Setaria italica
taaggaaataataaaagaagaaactacttgtttttgcaatgataacgtacatacagatatttctaaagccatcaagtacctagcttgtctaaataacaagtgtgtcctggaacaagtatcgagtacctgaaagcaacctgctttgaattggaaaggataaaaattcgacaaggaacgaacaaaggaggcacatttcttgccggccagaaactattgggtctttgcatccttgtgaattgataaacgtgctggtgtgtttcaatgatgtccatgagatgggaatacaaagtcaagcacgccttattaccttattgtgtggctctgtctgcagaaagcaaccgggcgcattttcttccgataccgtggttactttcaaattggaagacagagacgtacacacaaggcaataattcagggaacaattccatccatccactgctataaaaggcggtgttggggtgttgggtctcttcagttcagtgtgctcaagc

SEQ ID NO: 445 - DNA, 404 bp, Setaria italica
aaggaaataataaaagaagaaactacttgtttttgcaatgataacgtacatacagatatttctaaagccatcaagtacctagcttgtctaaataacaagtgtgtcctggaacaagtatcgagtacctgaaagcaacctgctttgaattggaaaggataaaaattcgacaaggaacgaacaaaggaggcacatttcttgccggccagaaactattgggtctttgcatccttgtgaattgataaacgtgctggtgtgtttcaatgatgtccatgagatgggaatacaaagtcaagcacgccttattaccttattgtgtggctctgtctgcagaaagcaaccgggcgcattttcttccgataccgtggttactttcaaattggaagacagagacgtacacacaaggc

SEQ ID NO: 446 - DNA, 1392 bp, Setaria italica
cgagacccgccacctcaccagcaccactactccctctttgctacaaccagagaaagtggcggaatcttgttgaacatcccactccgtgttgatgtggttgccacgagatctgcctgcatcaagccatgttcgccacgcagccatgcgcgccgctggccatcacgccctcgcacatcatgcagttggatgtttaacccttgcgatcaaagtacgaaatagtgggctatagcgaagctatagtggcgctatagcggttgatgctagctgccgctacaacaacgttgtactaattagcgggttatagtgggctatagcggagctatagcggttgagcatagctctatgctgaatcccatagtccgctattttgtatattgcttgcgatgtgtggagctgcgtccacatagtgtgatttcagctatgcttccactaatttgtgtcgatctacattagattaagagagaagactacagagatagtagaacaaatagagagagctaatacgagagagagagagggtgacggggcttgacgcgcacaatgcacaggaacatgatgataagccttgggtctatcttggtgctgacagacgatggcctgcatgcatgattttgatatgtttttcaatcaaataatttttttgaaaaaaatcaaaaccacatcctagaaaggcgaacacactaaaaaaaactgaaaaactgaagaaattagttgaaacgtgggtttagtgtttctccccagctattgtaaaattcaaaaaataagggcaaaatatattgttgaaggtggaaataagagtagttatacataaaattgatgtacattgtttgcagtggaaaatgaaataaatagcgtatgcatatggtctttcacctgcagtatcgtacgggcgtatttgctagtatcttataagagtgtaatatagaacatcaaaaagaagagttttcaacatttgagatgtaattgcatatgtgatcaaatggttggtcaggaccgagatcaacatttgaccttagtctgcaaggggcatgggcagacggaaaccacacgacccatcggcagaaacagtgtggaggtttggttaactccagccaactaaagaaaagtgctaatctactgaacaattccatctccagccgactaacccaccgcacaatgaactggaccgaccccagtcgagaggttggttcatcgaagttcaccgcgggtggtgaaccaaacgggaagcgccgcgccgcgtcaacccaaacgccgtgagccggggccaccgcgcctccccaccgtcctcgtccacgtgcgccgcacacacgcggagaactacgccgcgcaccgccgaaacgccctgttctccctttttataccggcctcctccctccccttcgccacccgcac

SEQ ID NO: 447 - DNA, 1396 bp, Setaria italica
ccaacgagacccgccacctcaccagcaccactactccctctttgctacaaccagagaaagtggcggaatcttgttgaacatcccactccgtgttgatgtggttgccacgagatctgcctgcatcaagccatgttcgccacgcagccatgcgcgccgctggccatcacgccctcgcacatcatgcagttggatgtttaacccttgcgatcaaagtacgaaatagtgggctatagcgaagctatagtggcgctatagcggttgatgctagctgccgctacaacaacgttgtactaattagcgggttatagtgggctatagcggagctatagcggttgagcatagctctatgctgaatcccatagtccgctattttgtatattgcttgcgatgtgtggagctgcgtccacatagtgtgatttcagctatgcttccactaatttgtgtcgatctacattagattaagagagaagactacagagatagtagaacaaatagagagagctaatacgagagagagagagggtgacggggcttgacgcgcacaatgcacaggaacatgatgataagccttgggtctatcttggtgctgacagacgatggcctgcatgcatgattttgatatgtttttcaatcaaataatttttttgaaaaaaatcaaaaccacatcctagaaaggcgaacacactaaaaaaaactgaaaaactgaagaaattagttgaaacgtgggtttagtgtttctccccagctattgtaaaattcaaaaaataagggcaaaatatattgttgaaggtggaaataagagtagttatacataaaattgatgtacattgtttgcagtggaaaatgaaataaatagcgtatgcatatggtctttcacctgcagtatcgtacgggcgtatttgctagtatcttataagagtgtaatatagaacatcaaaaagaagagttttcaacatttgagatgtaattgcatatgtgatcaaatggttggtcaggaccgagatcaacatttgaccttagtctgcaaggggcatgggcagacggaaaccacacgacccatcggcagaaacagtgtggaggtttggttaactccagccaactaaagaaaagtgctaatctactgaacaattccatctccagccgactaacccaccgcacaatgaactggaccgaccccagtcgagaggttggttcatcgaagttcaccgcgggtggtgaaccaaacgggaagcgccgcgccgcgtcaacccaaacgccgtgagccggggccaccgcgcctccccaccgtcctcgtccacgtgcgccgcacacacgcggagaactacgccgcgcaccgccgaaacgccctgttctccctttttataccggcctcctccctccccttcgccacccgcac

SEQ ID NO: 448 - DNA, 2074 bp, Setaria italica
actatggcgggcgtggtgagacccccgcacgtggtgtttcttcaaggcgatgagagtgaggtggagtccaacggcggatgtggcgaggtccccgcgcattgtgttatcgcggtggcgactgcgaggcagcctaagagaggtccggattcggtggtatcactctgtcagatagagtgtggtgttgcagcggcactacagcggagggtctcgtatggcggtggccatctcggtgcagtgcagtctgtttctatcggttccctgtcgatgccggaccacgcctagacgtttcggcgagttatgagcgtggatgttggtgggtgccgccgtggcgagcagagcggtgagaccgtgttgatgtcccaatccaatcggtagggtgtgatagttttggtgttgagtggctatctgcattgatgtcctaatccgaccaggcgagtttgtattgtttttcttttcttttccttttatattttttcagtctgaaattctttttttaatataatcggcagctctccaatatggttcgttcaaaaaaaagaatttttaagaaaagatagataaaaagataaaccaaattctgaattgtgattcagataccctcgaaatggaagttggcctgtccacttaaaattgaacgcatgattccgtcaataattcagtgccgtcctcctgtttactctttaattcttattacgtgacatcggcccgttgataagccgtgctccttgtcgctaattcttattacgtgctgatagaggcgagtcaatcaaacgttgcactttgtaacccttaatctttgctaagagtcacatgaccccgtacatctcgatcgatcctcttttagttggcgcgcgggttttaccatgtgaagcaatgtgccggcatgctgctgtcgcaactagctcttcatcaagctatcgacagatgagatgcgctcccattggaaccgaaatgggtggaaattctgttcgattctgtcgtgccgaccgtgcgaaagtgaaaccacccttcccctcgccgcaggcatgtagtccgcgtggattttgaacaccacagctgacatatgcctccatgtccattcctgccgtgggaatctctgcacctggtctgcctagtcctacaggctgcggccgcaccatctaaatgcatgtttgaatatcagtagttaaattttatcacatgtcacatcggatattcggatgctaattagtaggactaaacatagctaattataaaattaattgcagaacttcggggctaattcatgagaccaatttattgaggctaattaatctatcattagcaaatggttactgtagcaccatattgtcaaatcatggactaattagccttaatagatttatctcacaaattagactccatctgtgtaattagttttataattagattatatttaatacttctaattagtatccaaatatccgatgtgactgtgaagtttaacacatgtgagccaaacacccccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgcataattagcagcttgtttattaagcttaaacgattgatcctactccttgccgacagggccgcgagcaaagtcaactgctcgacacctcctcggccaacgtgcctatatattctcggctagccgcgtccgtactcatccaacccaactccaagcacctcatcagattcctcgcctccgtctccgaccacccaccagtcaggtaactagctagagaggaagagatcaccggccggcgatcgattattaacgcgtcaggagaagcg

SEQ ID NO: 449 - DNA, 2035 bp, Setaria italica
tcttcaaggcgatgagagtgaggtggagtccaacggcggatgtggcgaggtccccgcgcattgtgttatcgcggtggcgactgcgaggcagcctaagagaggtccggattcggtggtatcactctgtcagatagagtgtggtgttgcagcggcactacagcggagggtctcgtatggcggtggccatctcggtgcagtgcagtctgtttctatcggttccctgtcgatgccggaccacgcctagacgtttcggcgagttatgagcgtggatgttggtgggtgccgccgtggcgagcagagcggtgagaccgtgttgatgtcccaatccaatcggtagggtgtgatagttttggtgttgagtggctatctgcattgatgtcctaatccgaccaggcgagtttgtattgtttttcttttcttttccttttatattttttcagtctgaaattctttttttaatataatcggcagctctccaatatggttcgttcaaaaaaagaatttttaagaaaagatagataaaaagataaaccaaattctgaattgtgattcagataccctcgaaatggaagttggcctgtccacttaaaattgaacgcatgattccgtcaataattcagtgccgtcctcctgtttactctttaattcttattacgtgacatcggcccgttgataagccgtgctccttgtcgctaattcttattacgtgctgatagaggcgagtcaatcaaacgttgcactttgtaacccttaatctttgctaagagtcacatgaccccgtacatctcgatcgatcctcttttagttggcgcgcgggttttaccatgtgaagcaatgtgccggcatgctgctgtcgcaactagctcttcatcaagctatcgacagatgagatgcgctcccattggaaccgaaatgggtggaaattctgttcgattctgtcgtgccgaccgtgcgaaagtgaaaccacccttcccctcgccgcaggcatgtagtccgcgtggattttgaacaccacagctgacatatgcctccatgtccattcctgccgtgggaatctctgcacctggtctgcctagtcctacaggctgcggccgcaccatctaaatgcatgtttgaatatcagtagttaaattttatcacatgtcacatcggatattcggatgctaattagtaggactaaacatagctaattataaaattaattgcagaacttcggggctaattcatgagaccaatttattgaggctaattaatctatcattagcaaatggttactgtagcaccatattgtcaaatcatggactaattagccttaatagatttatctcacaaattagactccatctgtgtaattagttttataattagattatatttaatacttctaattagtatccaaatatccgatgtgactgtgaagtttaacacatgtgagccaaacacccccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgcataattagcagcttgtttattaagcttaaacgattgatcctactccttgccgacagggccgcgagcaaagtcaactgctcgacacctcctcggccaacgtgcctatatattctcggctagccgcgtccgtactcatccaacccaactccaaacacctcatcagattcctcgcctccgtctccgaccacccaccagtcaggtaactagctagagaggaagagatcaccggccggcgatcgattattaacgcgtcaggagaagcg

SEQ ID NO: 450 - DNA, 380 bp, Setaria italica
cgacggcccgggctggtctgcagcgctgctgttggccctgccctcgtcaagatctgacttttgaatcgcataattagcagcttgtttattaagcttaaacgattgatcctactccttgccgacagggccgcgagcaaagtcaactgctcgacacctcctcggccaacgtgcctatatattctcggctagccgcgtccgtactcatccaacccaactccaagcacctcatcagattcctcgcctccgtctccgaccacccaccagtcaggtaactagctagagaggaagagatcaccggccggcgatcgattattaacgcgtcaggagaagcgatggctcggcaacaaggcgccgtggtgttctcgttgcttgcggcggtg

SEQ ID NO: 451 - DNA, 590 bp, Setaria italica
ccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgcataattagcagcttgtttattaagcttaaacgattgatcctactccttgccgacagggccgcgagcaaagtcaactgctcgacacctcctcggccaacgtgcctatatattctcggctagccgcgtccgtactcatccaacccaactccaaacacctcatcagattcctcgcctccgtctccgaccacccaccagtcaggtaactagctagagaggaagagatcaccggccggcgatcgattattaacgcgtcaggagaagcg

SEQ ID NO: 452 - DNA, 1794 bp, Setaria italica
gagacccccgcacgtggtgtttcttcaaggcgatgagagtgaggtggagtccaacggcggatgtggcgaggtccccgcgcattgtgttatcgcggtggcgactgcgaggcagcctaagagaggtccggattcggtggtatcactctgtcagatagagtgtggtgttgcagcggcactacagcggagggtctcgtatggcggtggccatctcggtgcagtgcagtctgtttctatcggttccctgtcgatgccggaccacgcctagacgtttcggcgagttatgagcgtggatgttggtgggtgccgccgtggcgagcagagcggtgagaccgtgttgatgtcccaatccaatcggtagggtgtgatagttttggtgttgagtggctatctgcattgatgtcctaatccgaccaggcgagtttgtattgtttttcttttcttttccttttatattttttcagtctgaaattctttttttaatataatcggcagctctccaatatggttcgttcaaaaaaaagaatttttaagaaaagatagataaaaagataaaccaaattctgaattgtgattcagataccctcgaaatggaagttggcctgtccacttaaaattgaacgcatgattccgtcaataattcagtgccgtcctcctgtttactctttaattcttattacgtgacatcggcccgttgataagccgtgctccttgtcgctaattcttattacgtgctgatagaggcgagtcaatcaaacgttgcactttgtaacccttaatctttgctaagagtcacatgaccccgtacatctcgatcgatcctcttttagttggcgcgcgggttttaccatgtgaagcaatgtgccggcatgctgctgtcgcaactagctcttcatcaagctatcgacagatgagatgcgctcccattggaaccgaaatgggtggaaattctgttcgattctgtcgtgccgaccgtgcgaaagtgaaaccacccttcccctcgccgcaggcatgtagtccgcgtggattttgaacaccacagctgacatatgcctccatgtccattcctgccgtgggaatctctgcacctggtctgcctagtcctacaggctgcggccgcaccatctaaatgcatgtttgaatatcagtagttaaattttatcacatgtcacatcggatattcggatgctaattagtaggactaaacatagctaattataaaattaattgcagaacttcggggctaattcatgagaccaatttattgaggctaattaatctatcattagcaaatggttactgtagcaccatattgtcaaatcatggactaattagccttaatagatttatctcacaaattagactccatctgtgtaattagttttataattagattatatttaatacttctaattagtatccaaatatccgatgtgactgtgaagtttaacacatgtgagccaaacacccccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgc

SEQ ID NO: 453 - DNA, 590 bp, Setaria italica
ccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgcataattagcagcttgtttattaagcttaaacgattgatcctactccttgccgacagggccgcgagcaaagtcaactgctcgacacctcctcggccaacgtgcctatatattctcggctagccgcgtccgtactcatccaacccaactccaagcacctcatcagattcctcgcctccgtctccgaccacccaccagtcaggtaactagctagagaggaagagatcaccggccggcgatcgattattaacgcgtcaggagaagcg

SEQ ID NO: 454 - DNA, 1815 bp, Setaria italica
  misc_feature (339)..(339): r= g or a.
caaagttcgtgttttcagaagggctagcttttttgtaagactagcaaaatgacttagcatcttaccttactagtggtacggagatgttaaataactaaatatgagaaattcctataaaaatcaagcaccattaaaatttttaccacgggagttaatttgcttctaaattacccactcattccactaaaatagtaaatatatacagtacccacatccattattgtaaaaatagcataaactaaccattattctgcattcaaattatacatggatatttaatctacatctaaaataaccaaaattaccattatacgtgcttctaaataccaacttttggargcttgcagtggaaactgtccatccaggtaaaatcagaatgtttccactaaaatgttataaagatttcttgtggtgaaacttatatatatagatttgagcctctaactcaacacgaatgtttgtatctgctaattctttttttccaatggtaggcgatgggatcatcaacatcaaggtagctgtggtgacttcatgagtctgaagatttgttgaactagtagtctttcgatcgaagatgttcataagtataggatgttcatgtatgaattcagagggtttttgcgtgtgagcatttttgcacgcgtccgcatctttacaatgttttaaaatcaccaacttctgtcattttctacctttatagttcttctctagttgaattcattttatttgattgcactttaaatagaatcatctatatgtttactaaaatattattacatatatacattgatgttttaatcgtaaacacatcaattattttagaaaaaaatacatgactacactcatagttgttctatagaggaaattgattcttgggtactttggtgaaagctgaaacatctatttattccattacagtaaccaagagtatagtaactaaaaatctaaattcttaatagaatccatatatagcatatagaataataggtacaacatgctatagagtttcaagttaatatttggagaattttttttggcatacgaattgcagtaggtaagattgaatgggaagccaaaatctggattcatgaagtcacaagagatgagcttgaacagaagctgtcataattcaagctaattttgattaaacatatatcaaacgcaccgcgttacgatacaataggaaataaactatgaatgggtattaaaaaacatacacaataatttataacctaaatatatgataaagatcacagcgcatttatgtaattaatgcatcttaaagttgccattagtggggaatgcaagtgtttttctccgcaaacccgcatataccatctcaaaaaatgacgtacatgtacatgcgggttcgcggacaagcccatttgtatctctattgctagccacatgggagcacaagttgatggattagttgaacactatcaggcaacatgtaattaaacagtgtttgttttgaacttcgtgcaagtgagatacttttacttggtctccaaatgcatgcattctctgaaattaccaatcttatcctagtgtgaaccaacaaaaatgtacacacaaccagaccatgtcgtttccaggttggaacgcaaactaaattgtcaatctttgcaaagcaaccaagaattacgagatcaacaatttttgtggcgccgaagagtgctcctcaaagtgccaagcgttagtgtgctagctaggccgtaacgaaacttgtggcgcatactgccttttgaggcgccgcgcccgtgtatatatacgccccctcatgcatgctctccttgagcaggcagccaggca

SEQ ID NO: 455 - DNA, 1864 bp, Setaria italica
  misc_feature (388)..(388): r= g or a.
ccaaaatttacaaaccttatacaaaatagtataatccagtacgaactttcaaagttcgtgttttcagaagggctagcttttttgtaagactagcaaaatgacttagcatcttaccttactagtggtacggagatgttaaataactaaatatgagaaattcctataaaaatcaagcaccattaaaatttttaccacgggagttaatttgcttctaaattacccactcattccactaaaatagtaaatatatacagtacccacatccattattgtaaaaatagcataaactaaccattattctgcattcaaattatacatggatatttaatctacatctaaaataaccaaaattaccattatacgtgcttctaaataccaacttttggargcttgcagtggaaactgtccatccaggtaaaatcagaatgtttccactaaaatgttataaagatttcttgtggtgaaacttatatatatagatttgagcctctaactcaacacgaatgtttgtatctgctaattctttttttccaatggtaggcgatgggatcatcaacatcaaggtagctgtggtgacttcatgagtctgaagatttgttgaactagtagtctttcgatcgaagatgttcataagtataggatgttcatgtatgaattcagagggtttttgcgtgtgagcatttttgcacgcgtccgcatctttacaatgttttaaaatcaccaacttctgtcattttctacctttatagttcttctctagttgaattcattttatttgattgcactttaaatagaatcatctatatgtttactaaaatattattacatatatacattgatgttttaatcgtaaacacatcaattattttagaaaaaaatacatgactacactcatagttgttctatagaggaaattgattcttgggtactttggtgaaagctgaaacatctatttattccattacagtaaccaagagtatagtaactaaaaatctaaattcttaatagaatccatatatagcatatagaataataggtacaacatgctatagagtttcaagttaatatttggagaattttttttggcatacgaattgcagtaggtaagattgaatgggaagccaaaatctggattcatgaagtcacaagagatgagcttgaacagaagctgtcataattcaagctaattttgattaaacatatatcaaacgcaccgcgttacgatacaataggaaataaactatgaatgggtattaaaaaacatacacaataatttataacctaaatatatgataaagatcacagcgcatttatgtaattaatgcatcttaaagttgccattagtggggaatgcaagtgtttttctccgcaaacccgcatataccatctcaaaaaatgacgtacatgtacatgcgggttcgcggacaagcccatttgtatctctattgctagccacatgggagcacaagttgatggattagttgaacactatcaggcaacatgtaattaaacagtgtttgttttgaacttcgtgcaagtgagatacttttacttggtctccaaatgcatgcattctctgaaattaccaatcttatcctagtgtgaaccaacaaaaatgtacacacaaccagaccatgtcgtttccaggttggaacgcaaactaaattgtcaatctttgcaaagcaaccaagaattacgagatcaacaatttttgtggcgccgaagagtgctcctcaaagtgccaagcgttagtgtgctagctaggccgtaacgaaacttgtggcgcatactgccttttgaggcgccgcgcccgtgtatatatacgccccctcatgcatgctctccttgagcaggcagccaggca

SEQ ID NO: 456 - DNA, 2263 bp, Setaria italica
caaagttcgtgttttcagaagggctagcttttttgtaagactagcaaaatgacttagcatcttaccttactagtggtacggagatgttaaataactaaatatgagaaattcctataaaaatcaagcaccattaaaatttttaccacgggagttaatttgcttctaaattacccactcattccactaaaatagtaaatatatacagtacccacatccattattgtaaaaatagcataaactaaccattattctgcattcaaattatacatggatatttaatctacatctaaaataaccaaaattaccattatacgtgcttctaaataccaacttttggaagcttgcagtggaaactgtccatccaggtaaaatcagaatgtttccactaaaatgttataaagatttcttgtggtgaaacttatatatatagatttgagcctctaactcaacacgaatgtttgtatctgctaattctttttttccaatggtaggcgatgggatcatcaacatcaaggtagctgtggtgacttcatgagtatgaagatttgttgaactagtagtctttcgaagatgttcttaagtgtaggatgttcatgtatgaattcagagggtttttgcgtgtgagcatttttgcacgcgtccgcgtctttacaatgttttaaaaattcaccaacttctgtcattttctacctttatagttcttctctagttgaaaccaaattatttaatctacatctaaaataacccaaattaccattatacgtgcttctaaataccaacttttggaagcttgcagtggaaactgtccatccaggtaaaatcagaatgtttccacttaaatattatgaagatttcttgtggtgaaatatatatatagatttgagcctctaactcaacacgaatgtttgtatctgctaattcttttttccaatggtaggcgatgggatcatcaacatcaaggtagctgtggtgacttcatgagtctgaagatttgttgaactagtagtctttcgatcgaagatgttcataagtataggatgttcatgtatgaattcagagggtttttgcgtgtgagcatttttgcacgcgtccgcatctttacaatgttttaaaatcaccaacttctgtcattttctacctttatagttcttctctagttgaattcattttatttgattgcactttaaatagaatcatctatatgtttactaaaatattattacatatatacattgatgttttaatcgtaaacacatcaattattttagaaaaaaatacatgactacactcatagttgttctatagaggaaatttgatatcttgggtactttggtgaaagctgaaacatctatttattccattacagtaaccaagagtatagtaactaaaaatctaaattcttaatagaatccatatatagcatatagaataataggtacaacatgctatagagtttcaagttaatatttggagaattttttttggcatacgaattgcagtaggtaagattgaatgggaagccaaaatctggattcatgaagtcacaagagatgagcttgaacagaagctgtcataattcaagctaattttgattaaacatatatcaaacgcaccgcgttacgatacaataggaaataaactatgaatgggtattaaaaaacatacacaataatttataacctaaatatatgataaagatcacagcgcatttatgtaattaatgcatcttaaagttgccattagtggggaatgcaagtgtttttctccgcaaacccgcatataccatctcaaaaaatgacgtacatgtacatgcgggttcgcggacaagcccatttgtatctctattgctagccacatgggagcacaagttgatggattagttgaacactatcaggcaacatgtaattaaacagtgtttgttttgaacttcgtgcaagtgagatacttttacttggtctccaaatgcatgcattctctgaaattaccaatcttatcctagtgtgaaccaacaaaaatgtacacacaaccagaccatgtcgtttccaggttggaacgcaaactaaattgtcaatctttgcaaagcaaccaagaattacgagatcaacaatttttgtggcgccgaagagtgctcctcaaagtgccaagcgttagtgtgctagctaggccgtaacgaaacttgtggcgcatactgccttttgaggcgccgcgcccgtgtatatatacgccccctcatgcatgctctccttgagcaggcagccaggca

SEQ ID NO: 457 - DNA, 2348 bp, Setaria italica
actatagggcacgcgtggtcgacggcccgggctggtccaaaatttacaaaccttatacaaaatagtataatccagtacgaactttcaaagttcgtgttttcagaagggctagcttttttgtaagactagcaaaatgacttagcatcttaccttactagtggtacggagatgttaaataactaaatatgagaaattcctataaaaatcaagcaccattaaaatttttaccacgggagttaatttgcttctaaattacccactcattccactaaaatagtaaatatatacagtacccacatccattattgtaaaaatagcataaactaaccattattctgcattcaaattatacatggatatttaatctacatctaaaataaccaaaattaccattatacgtgcttctaaataccaacttttggaagcttgcagtggaaactgtccatccaggtaaaatcagaatgtttccactaaaatgttataaagatttcttgtggtgaaacttatatatatagatttgagcctctaactcaacacgaatgtttgtatctgctaattctttttttccaatggtaggcgatgggatcatcaacatcaaggtagctgtggtgacttcatgagtatgaagatttgttgaactagtagtctttcgaagatgttcttaagtgtaggatgttcatgtatgaattcagagggtttttgcgtgtgagcatttttgcacgcgtccgcgtctttacaatgttttaaaaattcaccaacttctgtcattttctacctttatagttcttctctagttgaaaccaaattatttaatctacatctaaaataacccaaattaccattatacgtgcttctaaataccaacttttggaagcttgcagtggaaactgtccatccaggtaaaatcagaatgtttccacttaaatattatgaagatttcttgtggtgaaatatatatatagatttgagcctctaactcaacacgaatgtttgtatctgctaattcttttttccaatggtaggcgatgggatcatcaacatcaaggtagctgtggtgacttcatgagtctgaagatttgttgaactagtagtctttcgatcgaagatgttcataagtataggatgttcatgtatgaattcagagggtttttgcgtgtgagcatttttgcacgcgtccgcatctttacaatgttttaaaatcaccaacttctgtcattttctacctttatagttcttctctagttgaattcattttatttgattgcactttaaatagaatcatctatatgtttactaaaatattattacatatatacattgatgttttaatcgtaaacacatcaattattttagaaaaaaatacatgactacactcatagttgttctatagaggaaatttgatatcttgggtactttggtgaaagctgaaacatctatttattccattacagtaaccaagagtatagtaactaaaaatctaaattcttaatagaatccatatatagcatatagaataataggtacaacatgctatagagtttcaagttaatatttggagaattttttttggcatacgaattgcagtaggtaagattgaatgggaagccaaaatctggattcatgaagtcacaagagatgagcttgaacagaagctgtcataattcaagctaattttgattaaacatatatcaaacgcaccgcgttacgatacaataggaaataaactatgaatgggtattaaaaaacatacacaataatttataacctaaatatatgataaagatcacagcgcatttatgtaattaatgcatcttaaagttgccattagtggggaatgcaagtgtttttctccgcaaacccgcatataccatctcaaaaaatgacgtacatgtacatgcgggttcgcggacaagcccatttgtatctctattgctagccacatgggagcacaagttgatggattagttgaacactatcaggcaacatgtaattaaacagtgtttgttttgaacttcgtgcaagtgagatacttttacttggtctccaaatgcatgcattctctgaaattaccaatcttatcctagtgtgaaccaacaaaaatgtacacacaaccagaccatgtcgtttccaggttggaacgcaaactaaattgtcaatctttgcaaagcaaccaagaattacgagatcaacaatttttgtggcgccgaagagtgctcctcaaagtgccaagcgttagtgtgctagctaggccgtaacgaaacttgtggcgcatactgccttttgaggcgccgcgcccgtgtatatatacgccccctcatgcatgctctccttgagcaggcagccaggca

SEQ ID NO: 458 - DNA, 2262 bp, Setaria italica
caaagttcgtgttttcagaagggctagcttttttgtaagactagcaaaatgacttagcatcttaccttactagtggtacggagatgttaaataactaaatatgagaaattcctataaaaatcaagcaccattaaaatttttaccacgggagttaatttgcttctaaattacccactcattccactaaaatagtaaatatatacagtacccacatccattattgtaaaaatagcataaactaaccattattctgcattcaaattatacatggatatttaatctacatctaaaataaccaaaattaccattatacgtgcttctaaataccaacttttggaagcttgcagtggaaactgtccatccaggtaaaatcagaatgtttccactaaaatgttataaagatttcttgtggtgaaacttatatatatagatttgagcctctaactcaacacgaatgtttgtatctgctaattctttttttccaatggtaggcgatgggatcatcaacatcaaggtagctgtggtgacttcatgagtatgaagatttgttgaactagtagtctttcgaagatgttcttaagtgtaggatgttcatgtatgaattcagagggtttttgcgtgtgagcatttttgcacgcgtccgcgtctttacaatgttttaaaaattcaccaacttctgtcattttctacctttatagttcttctctagttgaaaccaaattatttaatctacatctaaaataacccaaattaccattatacgtgcttctaaataccaacttttggaagcttgcagtggaaactgtccatccaggtaaaatcagaatgtttccacttaaatattatgaagatttcttgtggtgaaatatatatatagatttgagcctctaactcaacacgaatgtttgtatctgctaattcttttttccaatggtaggcgatgggatcatcaacatcaaggtagctgtggtgacttcatgagtctgaagatttgttgaactagtagtctttcgatcgaagatgttcataagtataggatgttcatgtatgaattcagagggtttttgcgtgtgagcatttttgcacgcgtccgcatctttacaatgttttaaaatcaccaacttctgtcattttctacctttatagttcttctctagttgaattcattttatttgattgcactttaaatagaatcatctatatgtttactaaaatattattacatatatacattgatgttttaatcgtaaacacatcaattattttagaaaaaaatacatgactacactcatagttgttctatagaggaaatttgatatcttgggtactttggtgaaagctgaaacatctatttattccattacagtaaccaagagtatagtaactaaaaatctaaattcttaatagaatccatatatagcatatagaataataggtacaacatgctatagagtttcaagttaatatttggagaattttttttggcatacgaattgcagtaggtaagattgaatgggaagccaaaatctggattcatgaagtcacaagagatgagcttgaacagaagctgtcataattcaagctaattttgattaaacatatatcaaacgcaccgcgttacgatacaataggaaataaactatgaatgggtattaaaaaacatacacaataatttataacctaaatatatgataaagatcacagcgcatttatgtaattaatgcatcttaaagttgccattagtggggaatgcaagtgtttttctccgcaaacccgcatataccatctcaaaaaatgacgtacatgtacatgcgggttcgcggacaagcccatttgtatctctattgctagccacatgggagcacaagttgatggattagttgaacactatcaggcaacatgtaattaaacagtgtttgttttgaacttcgtgcaagtgagatacttttacttggtctccaaatgcatgcattctctgaaattaccaatcttatcctagtgtgaaccaacaaaaatgtacacacaaccagaccatgtcgtttccaggttggaacgcaaactaaattgtcaatctttgcaaagcaaccaagaattacgagatcaacaatttttgtggcgccgaagagtgctcctcaaagtgccaagcgttagtgtgctagctaggccgtaacgaaacttgtggcgcatactgccttttgaggcgccgcgcccgtgtatatatacgccccctcatgcatgctctccttgagcaggcagccaggc

SEQ ID NO: 459 - DNA, 1967 bp, Setaria italica
  misc_feature (388)..(388): r= g or a.
ccaaaatttacaaaccttatacaaaatagtataatccagtacgaactttcaaagttcgtgttttcagaagggctagcttttttgtaagactagcaaaatgacttagcatcttaccttactagtggtacggagatgttaaataactaaatatgagaaattcctataaaaatcaagcaccattaaaatttttaccacgggagttaatttgcttctaaattacccactcattccactaaaatagtaaatatatacagtacccacatccattattgtaaaaatagcataaactaaccattattctgcattcaaattatacatggatatttaatctacatctaaaataaccaaaattaccattatacgtgcttctaaataccaacttttggargcttgcagtggaaactgtccatccaggtaaaatcagaatgtttccactaaaatgttataaagatttcttgtggtgaaacttatatatatagatttgagcctctaactcaacacgaatgtttgtatctgctaattctttttttccaatggtaggcgatgggatcatcaacatcaaggtagctgtggtgacttcatgagtctgaagatttgttgaactagtagtctttcgatcgaagatgttcataagtataggatgttcatgtatgaattcagagggtttttgcgtgtgagcatttttgcacgcgtccgcatctttacaatgttttaaaatcaccaacttctgtcattttctacctttatagttcttctctagttgaattcattttatttgattgcactttaaatagaatcatctatatgtttactaaaatattattacatatatacattgatgttttaatcgtaaacacatcaattattttagaaaaaaatacatgactacactcatagttgttctatagaggaaattgattcttgggtactttggtgaaagctgaaacatctatttattccattacagtaaccaagagtatagtaactaaaaatctaaattcttaatagaatccatatatagcatatagaataataggtacaacatgctatagagtttcaagttaatatttggagaattttttttggcatacgaattgcagtaggtaagattgaatgggaagccaaaatctggattcatgaagtcacaagagatgagcttgaacagaagctgtcataattcaagctaattttgattaaacatatatcaaacgcaccgcgttacgatacaataggaaataaactatgaatgggtattaaaaaacatacacaataatttataacctaaatatatgataaagatcacagcgcatttatgtaattaatgcatcttaaagttgccattagtggggaatgcaagtgtttttctccgcaaacccgcatataccatctcaaaaaatgacgtacatgtacatgcgggttcgcggacaagcccatttgtatctctattgctagccacatgggagcacaagttgatggattagttgaacactatcaggcaacatgtaattaaacagtgtttgttttgaacttcgtgcaagtgagatacttttacttggtctccaaatgcatgcattctctgaaattaccaatcttatcctagtgtgaaccaacaaaaatgtacacacaaccagaccatgtcgtttccaggttggaacgcaaactaaattgtcaatctttgcaaagcaaccaagaattacgagatcaacaatttttgtggcgccgaagagtgctcctcaaagtgccaagcgttagtgtgctagctaggccgtaacgaaacttgtggcgcatactgccttttgaggcgccgcgcccgtgtatatatacgccccctcatgcatgctctccttgagcaggcagccaggcacgcaccaataccaagcctctcccgggccagcttctagcattggctcatcaccagcactccagcaggcaggcaaaacgcaagcaacacctctccgccagacatc

SEQ ID NO: 460 - DNA, 1827 bp, Setaria italica
tcttcaaggcgatgagagtgaggtggagtccaacggcggatgtggcgaggtccccgcgcattgtgttatcgcggtggcgactgcgaggcagcctaagagaggtccggattcggtggtatcactctgtcagatagagtgtggtgttgcagcggcactacagcggagggtctcgtatggcggtggccatctcggtgcagtgcagtctgtttctatcggttccctgtcgatgccggaccacgcctagacgtttcggcgagttatgagcgtggatgttggtgggtgccgccgtggcgagcagagcggtgagaccgtgttgatgtcccaatccaatcggtagggtgtgatagttttggtgttgagtggctatctgcattgatgtcctaatccgaccaggcgagtttgtattgtttttcttttcttttccttttatattttttcagtctgaaattctttttttaatataatcggcagctctccaatatggttcgttcaaaaaaagaatttttaagaaaagatagataaaaagataaaccaaattctgaattgtgattcagataccctcgaaatggaagttggcctgtccacttaaaattgaacgcatgattccgtcaataattcagtgccgtcctcctgtttactctttaattcttattacgtgacatcggcccgttgataagccgtgctccttgtcgctaattcttattacgtgctgatagaggcgagtcaatcaaacgttgcactttgtaacccttaatctttgctaagagtcacatgaccccgtacatctcgatcgatcctcttttagttggcgcgcgggttttaccatgtgaagcaatgtgccggcatgctgctgtcgcaactagctcttcatcaagctatcgacagatgagatgcgctcccattggaaccgaaatgggtggaaattctgttcgattctgtcgtgccgaccgtgcgaaagtgaaaccacccttcccctcgccgcaggcatgtagtccgcgtggattttgaacaccacagctgacatatgcctccatgtccattcctgccgtgggaatctctgcacctggtctgcctagtcctacaggctgcggccgcaccatctaaatgcatgtttgaatatcagtagttaaattttatcacatgtcacatcggatattcggatgctaattagtaggactaaacatagctaattataaaattaattgcagaacttcggggctaattcatgagaccaatttattgaggctaattaatctatcattagcaaatggttactgtagcaccatattgtcaaatcatggactaattagccttaatagatttatctcacaaattagactccatctgtgtaattagttttataattagattatatttaatacttctaattagtatccaaatatccgatgtgactgtgaagtttaacacatgtgagccaaacacccccgaccacccggtcgccgcgccgcgccgcgccgttggatgccgcctcgccacgccatgcgacgcaacgccctgcactgcatttcgtggccttgcgtaggggcaccggaagagccgctggttcgtttcgttcgtcccctggccgcgtcagctgatttgcgagcagggtcgaatcgatcgcgcgcggtcgccgcatcccaccaagccggagcccttcggggcccctctaaaagcaagtcaggctcgcgaagtgaccgaaaagatacattactaccagctgcagcgctgctgttggccctgccctcgtcaagatctgacttttgaatcgcataattagcagcttgtttattaagcttaaacgattgatcctactccttgccgaca

SEQ ID NO: 461 - DNA, 1069 bp, Setaria italica
gtcatagacattcttaatagagcatgggctcgcttccatcaacgtcactcaagtgaattcaaggagcaacttcatatccactttgaattcccggtatgtattgaatttgcacatctcatgtcacttccttgaacccaacaaatatttcataacttcttttaccgtatatatagtgtttgagatagaatctgaagaataatttatgcggatactacgtatatgagtttatccatggctttgtaggttccaagcgtataactgaccatgaattcagagtacatatacaaatttcttaacaataaattagttctaattgttcagatccattgatctaatataataacctttgctaatgacatagattatgcacatgaaagaggaactcctcgagatagaaaaaatcagggcaattcaataacaactcagtggaattcttttagatgaggtagtaaatccagtaggagagttccataatgatggatcaaatatacatcaccgtcaggactcgggtccagaatagttgatctaaaatgttgaacttggagagttgatgcaacgtaatattattcatataagtgtatgcacaatatgtctatgtataatattatcttaattgtaatattatagatcaaatacaacttcatatattgcgtattcgtaagaaaaaaatacaaaatactaatatagaataaagaaacagaaaagaaaagaaaagaaaagaaatataaaagaaaaaaagaatttagtatcggttggtctccccagccagtactaaaggaacccttttgtactgacttagcaatactggttgcacaatcggtactaaaggggggtttggacctagtactgaaggcgcttcctcagcagtggctcacctctccattagtgttggggagcccactctatcgctttatcgtctctcttccatgtaagcaaaatgatacttggccggcctcctatgagccagctgagttgttattgattgaggacgcctcacagatgctttccagtagcaggccgataggcattatttaaacccttcgtaggcactaacccagcaatagcatca

SEQ ID NO: 462 - DNA, 980 bp, Setaria italica
aactccatgccgtggtgcctccacacgcgcagcctccgttgtgcctccttgcgtgcagcctccgcgctgttgcacctagctcgtgtgtggaccgctgcacctcctcgccgctatagcaccctccgctgagagcaagggccaacactgccctcgtgcaaccgccagctgctacccccgtagcccactgcccgagcagactcggccccgtgctcgctggatccggtcgcaactcatcgctgcatcgcgtgcgcccgcagcagatccgggcgagctcacagcagactcgggcaggcccatcttattgggccctgttgcggccatcctagctgccacacagggttccggcggcggcacggcagggttgagggaggaaagggtggcggccctcgggttgcgcggtccgccaatgccgcctctgagaaggagcgatgtggggttgtggatgccgtggccgctttagtgtacaactagttgcatccttatgctactacttttgtagattgctgttgtttacagctccgtaaatgctttatttctgtgttttcctctcatgattgtttttttaactattattgtatctctgacatttccctttcagtatattattttttcgtatatgcatagctgggagcctgggacatgtgcggaggtgcagcaagtactacctccgtccataaatctataacattttcattttttaagtcctaaacatgcaagtcagtacaagtgcgagtctacaccgcaaatacagatactgtttccctttcccaaaattgttttaatgtaggcgaccacacaacttgccctccacaacttgccatccacacatgccccatatgcgtgcacctaaattactgattactgagatacgcactcaatcacctgatcaaatataatcaagtgtagctcgatcgctaagccaggccgatgcactctatttaaacctatagcaaggaacttatagcgaagcaaacacatct

SEQ ID NO: 463 - DNA, 2277 bp, Setaria italica
tatcccctcctgtttcataaaaaaaatgaggatcagtggaaagctttgctttccaataccttggtaaaaattgctgtgtcgcggtgccaggagtttaccttctcgatctcatttacattccacatttcatattgcactttacattccgtgtttacctttcctagaattcttgcatgtgtaatttataggattggaacctagagtgcaaaactcttttgtagtagaaatagcaacacataaaaaactagtgcacatctagatagaaattgaaatacgtttttataggtgcatggagccttaatttttataacaccaaattcaccccctgatagagtgtcacagtcccttcaccgtcaacacggatcgattttgtgatggctgtcgtgttaggttgatcgtaagtacaatcattttcccattttgaacattcaaatcttcccaccaatttttaagtccgtgtttacctttcctacaattcttgcatgtgtaatttataggattggaacctagagtgcaaaactcttttatagtagaaatagcaacacataaaaaactagtgcacatctagatagaaattgaaatacgtttttataggtgcatggagccttaatttttataacaccaaattcaccccctgatagagtgtcacagtcccttcaccatcaacacggatcgattttgtgatggctgtcgtgttaggttgatcgtaagtacaatcattttcccattttgaacattcaaatcttcccaccaatttttaagtatttacctataatttctcttctatggcagcttcctgtagtggatgatttacctcttgcttgacgaagaaggtggttgggctgatggccatggcataaagggacccaacaaactcggcaccagtgatgatggcctgtagctggggagtaggaatataccctattattcccgaagagtctgagtgagaatccttgtggtagtagattgggtcaacaatgatttgcttttatgttcatacaaattttcagagagatcttttgctaaatctaattccatttggttgaagattactctttactttttatttatttaaattatttatgaaattagaccgaaacacatttcattttgtgttatgttccttgggattcatgtcagtctttggttttcatttcaaaatacacagatttcttccgaaatttgatgagaaaattctacagataattaaaaaatcgacgactacacaatttgtattagtgattggaatatcgtatgaacaaacatagtgacacaaagtgaatatgacttgtatgaatcaggcccacggagcataaatatctgcatatttgtctaactatccggttgctgtgacattgtgagctttttgaatttgccaactgatttgcgtaataagcttcttttaaagttatatgacgatttgcatattatctctagacaaattggaaggaaataaaggcttaaattatctgataatataattctatattttctcatgtcttcttgagaacgtagtacgcgaaaccaaataatagcaatatccaagatcctcatccgttgtcgtatcgctttactatttgtttgatgagcaggaatggatgagatcctggccgaactctgacagatagccgagaactgtcacattggcatgtcacggcatctgtacgtttgatatagggggcaggacttgcatgttgctttctcgagttacacgttatgagctatacatgttgctttctcgagttacacgttatgagctatagcctataactgaaatcgatcaataattacataattctgttgctcttttcttggctagttcactaatgcgatgggacatgaaatctgaaggtgaaatggatgacaccggtggacaaccagttgcgacgatatagtagctcgccagatatggaaaagtgaaaattcgacagattttattatagttaattcaacacgtgctcctgaggatgttgatccctgctacagagagctagctagactgaactagctacctagctcgaaaacataactagtcattgaaataacgacaaatgtttggttaaagtttgattaaataattttcatagactaaaaagctgttgtcatgcaaaaaattaccttgttctcaataattttttagcatggcctcttttatttgcaattgagcttgtatgtttttcacctagaaaattactgaacatggttattatacagttctaaggtaactctgaaccataagtctataaatagagctgtagcgtacatgtttttctatat

SEQ ID NO: 464 - DNA, 2250 bp, Setaria italica
gaggatcagtggaaagctttgctttccaataccttggtaaaaattgctgtgtcgcggtgccaggagtttaccttctcgatctcatttacattccacatttcatattgcactttacattccgtgtttacctttcctagaattcttgcatgtgtaatttataggattggaacctagagtgcaaaactcttttgtagtagaaatagcaacacataaaaaactagtgcacatctagatagaaattgaaatacgtttttataggtgcatggagccttaatttttataacaccaaattcaccccctgatagagtgtcacagtcccttcaccgtcaacacggatcgattttgtgatggctgtcgtgttaggttgatcgtaagtacaatcattttcccattttgaacattcaaatcttcccaccaatttttaagtccgtgtttacctttcctacaattcttgcatgtgtaatttataggattggaacctagagtgcaaaactcttttatagtagaaatagcaacacataaaaaactagtgcacatctagatagaaattgaaatacgtttttataggtgcatggagccttaatttttataacaccaaattcaccccctgatagagtgtcacagtcccttcaccatcaacacggatcgattttgtgatggctgtcgtgttaggttgatcgtaagtacaatcattttcccattttgaacattcaaatcttcccaccaatttttaagtatttacctataatttctcttctatggcagcttcctgtagtggatgatttacctcttgcttgacgaagaaggtggttgggctgatggccatggcataaagggacccaacaaactcggcaccagtgatgatggcctgtagctggggagtaggaatataccctattattcccgaagagtctgagtgagaatccttgtggtagtagattgggtcaacaatgatttgcttttatgttcatacaaattttcagagagatcttttgctaaatctaattccatttggttgaagattactctttactttttatttatttaaattatttatgaaattagaccgaaacacatttcattttgtgttatgttccttgggattcatgtcagtctttggttttcatttcaaaatacacagatttcttccgaaatttgatgagaaaattctacagataattaaaaaatcgacgactacacaatttgtattagtgattggaatatcgtatgaacaaacatagtgacacaaagtgaatatgacttgtatgaatcaggcccacggagcataaatatctgcatatttgtctaactatccggttgctgtgacattgtgagctttttgaatttgccaactgatttgcgtaataagcttcttttaaagttatatgacgatttgcatattatctctagacaaattggaaggaaataaaggcttaaattatctgataatataattctatattttctcatgtcttcttgagaacgtagtacgcgaaaccaaataatagcaatatccaagatcctcatccgttgtcgtatcgctttactatttgtttgatgagcaggaatggatgagatcctggccgaactctgacagatagccgagaactgtcacattggcatgtcacggcatctgtacgtttgatatagggggcaggacttgcatgttgctttctcgagttacacgttatgagctatacatgttgctttctcgagttacacgttatgagctatagcctataactgaaatcgatcaataattacataattctgttgctcttttcttggctagttcactaatgcgatgggacatgaaatctgaaggtgaaatggatgacaccggtggacaaccagttgcgacgatatagtagctcgccagatatggaaaagtgaaaattcgacagattttattatagttaattcaacacgtgctcctgaggatgttgatccctgctacagagagctagctagactgaactagctacctagctcgaaaacataactagtcattgaaataacgacaaatgtttggttaaagtttgattaaataattttcatagactaaaaagctgttgtcatgcaaaaaattaccttgttctcaataattttttagcatggcctcttttatttgcaattgagcttgtatgtttttcacctagaaaattactgaacatggttattatacagttctaaggtaactctgaaccataagtctataaatagagctgtagcgtacatgtttttctatat

SEQ ID NO: 465 - DNA, 1688 bp, Setaria italica
agcaaccattgtacactacgggaaatataatatgcataatggttgctctcccaccttcatgaggacagcctattggatgactcgcatcgggtgccatcaaagaacccatcaactactatattcatggactggaaggaaatgaggcaatcatctagctactacgtttttgggtgccttgatacaaagcgccttcatgctattatataggcacttaccataagtaccagtaaacaattaactcatacatctcgtagccaatgaactatgaatcagcagaaaatcattattttgtttgatcaactaaagcgcacgacctgtgacgtttggcacctagcccaagcattacaccgatatgtgatttaggtaatactcccacagtacattatgcataaccaacaccttaaattttgtacaatcagacttttcgtgatttgatcactatttgtataaacttatgtcactatcatgaaaacacctcagagatgcacattttcttggtacctgctcccattctactataacacctctccgtcccatccaagcagttggcctcttatttctttttggtgtatgtttctcagcctcgttcatggtgtctacctccatgcgaaacacgggttcagataagtgtgcaggtgcagtatctatgaaataaaggcagccaagttctcccagttcacaagagaaaatatcgtttataattatggtaataaaataatgtaggtctcaggacaaacaaccatatgtactcgcacatacaaatgtgattgcttcttgtaatcccaaattagtaatcgtcagtgcatgacttaaattagtaaacaattaactcatactccctccatcccacaaagagttattttaaaaaatttcagacagtatagtagtggtgagaaatgtatatgttgcccctaataactaatactagttgtcattaaaaatcatgcggtgtgtttagtttctcgatcctaaataaatgcacgcattgaaatcagagaaataacaccaattgattatttgattggctctacatacttctccatacttttttattattggtgtgagtgttgttttagttagatgagatttattaggaggtaaaggacactcttcgtgggacaaattgtagaatctaaaaggacactctttgcgggatgtagggagtatatctcatagacaatgaactatatgaatcagcagtaaccattgtttgatcaactaaagcatgacctatcatataaggctaatttaaattctgatcaatcagacatttcatgatttgactatttgtatttctaattctggagagtggatataagaaactatgtcactattatgaaaacaccctgagagatgcacattttctagatacctactcccactctactatgacacctctccatgccctccaagcagctggcctctaatttctcctggatgtaaggtttcttagcctcattcgtggtgtctctgtccacgcgaaacatgcgtgtgcagatacatgtacagatgcactatcgctttcctgacatagagtcctgatccgtccatagaaccatctctgtcctcgtggtccacgggaggatagctaaggccttattaattaacggtagcttactgatagtagctaagaaacacactatataataaccttcgtcaagaatgcagaacccatctaagcaaagcgc

SEQ ID NO: 466 - DNA, 1684 bp, Setaria italica
agcaaccattgtacactacgggaaatataatatgcataatggttgctctcccaccttcatgaggacagcctattggatgactcgcatcgggtgccatcaaagaacccatcaactactatattcatggactggaaggaaatgaggcaatcatctagctactacgtttttgggtgccttgatacaaagcgccttcatgctattatataggcacttaccataagtaccagtaaacaattaactcatacatctcgtagccaatgaactatgaatcagcagaaaatcattattttgtttgatcaactaaagcgcacgacctgtgacgtttggcacctagcccaagcattacaccgatatgtgatttaggtaatactcccacagtacattatgcataaccaacaccttaaattttgtacaatcagacttttcgtgatttgatcactatttgtataaacttatgtcactatcatgaaaacacctcagagatgcacattttcttggtacctgctcccattctactataacacctctccgtcccatccaagcagttggcctcttatttctttttggtgtatgtttctcagcctcgttcatggtgtctacctccatgcgaaacacgggttcagataagtgtgcaggtgcagtatctatgaaataaaggcagccaagttctcccagttcacaagagaaaatatcgtttataattatggtaataaaataatgtaggtctcaggacaaacaaccatatgtactcgcacatacaaatgtgattgcttcttgtaatcccaaattagtaatcgtcagtgcatgacttaaattagtaaacaattaactcatactccctccatcccacaaagagttattttaaaaaatttcagacagtatagtagtggtgagaaatgtatatgttgcccctaataactaatactagttgtcattaaaaatcatgcggtgtgtttagtttctcgatcctaaataaatgcacgcattgaaatcagagaaataacaccaattgattatttgattggctctacatacttctccatacttttttattattggtgtgagtgttgttttagttagatgagatttattaggaggtaaaggacactcttcgtgggacaaattgtagaatctaaaaggacactctttgcgggatgtagggagtatatctcatagacaatgaactatatgaatcagcagtaaccattgtttgatcaactaaagcatgacctatcatataaggctaatttaaattctgatcaatcagacatttcatgatttgactatttgtatttctaattctggagagtggatataagaaactatgtcactattatgaaaacaccctgagagatgcacattttctagatacctactcccactctactatgacacctctccatgccctccaagcagctggcctctaatttctcctggatgtaaggtttcttagcctcattcgtggtgtctctgtccacgcgaaacatgcgtgtgcagatacatgtacagatgcactatcgctttcctgacatagagtcctgatccgtccatagaaccatctctgtcctcgtggtccacgggaggatagctaaggccttattaattaacggtagcttactgatagtagctaagaaacacactatataataaccttcgtcaagaatgcagaacccatctaagcaaa

SEQ ID NO: 467 - DNA, 1434 bp, Setaria italica
gcgcagagtcacggcgtactagtcagctgccgagaggatggatgggatcatcgatcatgccaggatcgtcgtcgtttccttgacagtttttgaccttttgcgtcatgccgccccgagtcgtcaccattgcttgtgtctccttacgtggaaaattccatgaaccggccgaatagctttgtcgcaactgagctgaaaaaggagactgaaaatgatacaagtacttgatgtttggtgcgagatagacatcaccttttgaacggatcaattagtagtttgcagcgcaaacagacgattgaaaatgcaagcctgccagctgcactgatgggaaaagggcatcctaattcctgttcaaataaagggcatgattagcgggatactactacccatcatcttgtgcaaatttcttgagatgcttgtactgtttctgactgccgttggcgtctgacagcgagatgctgtgtgctgcagcagcaactctacggtgatattttccgtcgccatgcagtttttttcccgtgtggtaacaaaatacaagatttcctgtcgtcgccatacacttcaaaggtctagaaattaataaagcgaactctattttggaatgtttcgatgggactataacgattttctgaacgtctccagtactgatggttctaactgtcaaaattaaacttgtcgctttatcaatgtcttgactgccggtaactgacagatagtaacctatgcaagctttagtcaagaaacggagataagcacaactcagccacttgcacatcgcaatcactcggatcagttatagacctttctcacaggatttcaaccccagacaaattttgcatggctggcatggttgcattgcaggctaacaaccacgtgttgagtggagaaattgatgagatgccttcaggcttccttattctgaatattacatgtttttgtgctcttgtatctccttacctaatcgaacagaaaaggtgcagcaggagagccaaattctggtttgcgccaacaagaaagagagagagccagaatttgacaggcatgcttgattattctatattaaatcttatctggcatgcttgacaggaccagcaaatgttaaaaagatatgaaccgtacattgaagattgtgatgtctctaaaacatacagtatatgtcctccctagcctgcaagcactcgttcgtttaccattataatttggagactcgaaccatcttcatatgatgcatgacaaactaaccactcattactgatcgccaacaaacatgcatgcagctcacaccgctagcaaacagcaagacatgttaccaacagactgtcacgggcgcaaaaatgatcaaacgtgcaggctactatatatacgcaatatgcaatgcatgatattcaggccatcgatcgcaaacacttgaaaaggattgtagtagtgctactagtc

SEQ ID NO: 468 - DNA, 1487 bp, Setaria italica
acctacgcgcagagtcacggcgtactagtcagctgccgagaggatggatgggatcatcgatcatgccaggatcgtcgtcgtttccttgacagtttttgaccttttgcgtcatgccgccccgagtcgtcaccattgcttgtgtctccttacgtggaaaattccatgaaccggccgaatagctttgtcgcaactgagctgaaaaaggagactgaaaatgatacaagtacttgatgtttggtgcgagatagacatcaccttttgaacggatcaattagtagtttgcagcgcaaacagacgattgaaaatgcaagcctgccagctgcactgatgggaaaagggcatcctaattcctgttcaaataaagggcatgattagcgggatactactacccatcatcttgtgcaaatttcttgagatgcttgtactgtttctgactgccgttggcgtctgacagcgagatgctgtgtgctgcagcagcaactctacggtgatattttccgtcgccatgcagtttttttcccgtgtggtaacaaaatacaagatttcctgtcgtcgccatacacttcaaaggtctagaaattaataaagcgaactctattttggaatgtttcgatgggactataacgattttctgaacgtctccagtactgatggttctaactgtcaaaattaaacttgtcgctttatcaatgtcttgactgccggtaactgacagatagtaacctatgcaagctttagtcaagaaacggagataagcacaactcagccacttgcacatcgcaatcactcggatcagttatagacctttctcacaggatttcaaccccagacaaattttgcatggctggcatggttgcattgcaggctaacaaccacgtgttgagtggagaaattgatgagatgccttcaggcttccttattctgaatattacatgtttttgtgctcttgtatctccttacctaatcgaacagaaaaggtgcagcaggagagccaaattctggtttgcgccaacaagaaagagagagagccagaatttgacaggcatgcttgattattctatattaaatcttatctggcatgcttgacaggaccagcaaatgttaaaaagatatgaaccgtacattgaagattgtgatgtctctaaaacatacagtatatgtcctccctagcctgcaagcactcgttcgtttaccattataatttggagactcgaaccatcttcatatgatgcatgacaaactaaccactcattactgatcgccaacaaacatgcatgcagctcacaccgctagcaaacagcaagacatgttaccaacagactgtcacgggcgcaaaaatgatcaaacgtgcaggctactatatatacgcaatatgcaatgcatgatattcaggccatcgatcgcaaacacttgaaaaggattgtagtagtgctactagtcatggcttcctccctgtcagtggtagtgctcatcctgtgcctaagggc

SEQ ID NO: 469 - DNA, 2713 bp, Setaria italica
gcaaactgctttgtctcctctaacgtcttatcatgttgagaaatccttaaacctagggataattgtgggctcatatcaaatatactcctaaaaggttaaggctatataaagaaacatgtacccatctattatgataaaagagaacaatttccacctccattatctcctgtgtgcttatcacaggtgacatgctgacaacgatgtgctatcttcccgctcagtgccaggaggcgacctgccctgtcctgcacgactgctgctccagaaagaacacctcgcctctcgttttaatttgccccgacttttttattagaagatgattggaagggaatgagaagaattgagtataaaataaactaattttctctccaatcccttctattacacttcaatctactatccacacaagtactgaacgaaggttgcagagcgccagtcatctcgcttgacatgccccccagttcgctggtatcaggtttctcaacacccgatgatagaggagtactagtagcgtgctagtcagctgtgactcgaggtcagcgctggacagagttcgtatgctcgtaataatttacgctgtagatgtagtggactacagttttcgtgcgctgatcagcctagcgtgacctcgccggagttcacccgtggcgcaccattggctcgccgtccttttccgatcgagcaccaaatctccgcacgcttacacaggccgatcggatcgggacggcccgccgctagctggtcggtatagtagaaccgcccgacgacgtcgccggaaaccagtggacaggacacacacatacagcgcacgccgccgcatatttttatcggcccgtggcaagaatgtaaaccgccacccttgtccggcgctgccagcactgacacaggggatgcatcggggatgaccggggcccgtgacggcgacgcgagccgcccggctcttcacagccacaagggcgcaggtggcagcgccggattggtcggccgccgctcctcgtgtagtcgcgtgtactcgaggccagcgatctggaggccgccgttgagccaggtgtcgcctccgcaggatgcgtatgggcgtggaatgcgtacgtatgttgcgtaggaaaaaaaaggaggttcttcttcttcttacacagcagaggacgaaagactgattcggttcggtactgtgacctttgtggaaatggcggtcagggcaggcgaacgttccgtaaccctccgcttcgttgtcatgcttgtcttcgtcagggggagtgacctgggctggtctcttagctcatcatccggtaaagcgcggactcacagccaatgctaaggacaaacggacaataccgacccttcaattaggtcatgtggatgagtcattgggggaagggatcaggcaatgagaagagaacaaaatcacacaactcgatcagcaggacaactcacacgaacaaattaaagcaaaagccctgatcatgcaaagtactctaatcccaatgatcatctacaagtcttgtggagagttcgtggtcccagaagggtacaggattaggttaggggcgggcgattacatgacgcttgggaacgacagaggacatggcaagctgggctagaaacctctggagttttctttcagaaagaggggcgatgcatggaggaggacagctaatgccgtcgcgctcatccagcttgtagctaggttgcaactaatcgtgccccgcgataagaatctctatttgtacgtagacagggctcgctgcctggctgtgcgtgatgcatgcgacgcaatgattcgctgtccctgttgttcattattggctatcaagtttctgagcatctccattggcggataagtactactccaaattttctttttccagaagataacgctgccgaactgtttagttagtatatccacaccgtattctttgtcatgagctgaataaatgtccatgccaaatgtgtgcctcattttccaactggcaattggcagttggatatgtagcaagcaagggcatgctgacttcagtttagaaacttctggtgacgagtattctttttttggtttaaagaaacaagaagccctgattagttgcttgaagacgatgacagccatgctgacagcgcatgcgaagcagtgcaatagcacagggaatgcatgcactctggcaatattctgggttgcttgtttctagctacctgcaaataagtgttcgctactgcttcacgctccatgatgactcgtaacctcatgcatccaccctagctaattcttctgtcaacttcctagccacaccttagggtggtaatgtaccgccacgaaattaagctggaccactgattacaagcaccagtgtggttttgtgctttcagacgtcaggctagctcttaattcgcttaatttttttttcagaacgtatagtacgtaagcacagaacctatagaatataagctgaatagcccctccgattgatcactggccaccagtttggcttcggcgtgacataatggtgagggcttagtcggttgtgggcggcaaaaattataacccaaaaccctgtaaccagaaatggaacccttatccctcactaataatgtaatcaatcagtagtcgctaagcaagccatcattgaggcgatgagctcgccctctcccctgcacgagccgtcgacctcccgcgccccatatatacctcgcctctcccgtcccctcacacaccactctagct

SEQ ID NO: 470 - DNA, 2781 bp, Setaria italica
gcaaactgctttgtctcctctaacgtcttatcatgttgagaaatccttaaacctagggataattgtgggctcatatcaaatatactcctaaaaggttaaggctatataaagaaacatgtacccatctattatgataaaagagaacaatttccacctccattatctcctgtgtgcttatcacaggtgacatgctgacaacgatgtgctatcttcccgctcagtgccaggaggcgacctgccctgtcctgcacgactgctgctccagaaagaacacctcgcctctcgttttaatttgccccgacttttttattagaagatgattggaagggaatgagaagaattgagtataaaataaactaattttctctccaatcccttctattacacttcaatctactatccacacaagtactgaacgaaggttgcagagcgccagtcatctcgcttgacatgccccccagttcgctggtatcaggtttctcaacacccgatgatagaggagtactagtagcgtgctagtcagctgtgactcgaggtcagcgctggacagagttcgtatgctcgtaataatttacgctgtagatgtagtggactacagttttcgtgcgctgatcagcctagcgtgacctcgccggagttcacccgtggcgcaccattggctcgccgtccttttccgatcgagcaccaaatctccgcacgcttacacaggccgatcggatcgggacggcccgccgctagctggtcggtatagtagaaccgcccgacgacgtcgccggaaaccagtggacaggacacacacatacagcgcacgccgccgcatatttttatcggcccgtggcaagaatgtaaaccgccacccttgtccggcgctgccagcactgacacaggggatgcatcggggatgaccggggcccgtgacggcgacgcgagccgcccggctcttcacagccacaagggcgcaggtggcagcgccggattggtcggccgccgctcctcgtgtagtcgcgtgtactcgaggccagcgatctggaggccgccgttgagccaggtgtcgcctccgcaggatgcgtatgggcgtggaatgcgtacgtatgttgcgtaggaaaaaaaaggaggttcttcttcttcttacacagcagaggacgaaagactgattcggttcggtactgtgacctttgtggaaatggcggtcagggcaggcgaacgttccgtaaccctccgcttcgttgtcatgcttgtcttcgtcagggggagtgacctgggctggtctcttagctcatcatccggtaaagcgcggactcacagccaatgctaaggacaaacggacaataccgacccttcaattaggtcatgtggatgagtcattgggggaagggatcaggcaatgagaagagaacaaaatcacacaactcgatcagcaggacaactcacacgaacaaattaaagcaaaagccctgatcatgcaaagtactctaatcccaatgatcatctacaagtcttgtggagagttcgtggtcccagaagggtacaggattaggttaggggcgggcgattacatgacgcttgggaacgacagaggacatggcaagctgggctagaaacctctggagttttctttcagaaagaggggcgatgcatggaggaggacagctaatgccgtcgcgctcatccagcttgtagctaggttgcaactaatcgtgccccgcgataagaatctctatttgtacgtagacagggctcgctgcctggctgtgcgtgatgcatgcgacgcaatgattcgctgtccctgttgttcattattggctatcaagtttctgagcatctccattggcggataagtactactccaaattttctttttccagaagataacgctgccgaactgtttagttagtatatccacaccgtattctttgtcatgagctgaataaatgtccatgccaaatgtgtgcctcattttccaactggcaattggcagttggatatgtagcaagcaagggcatgctgacttcagtttagaaacttctggtgacgagtattctttttttggtttaaagaaacaagaagccctgattagttgcttgaagacgatgacagccatgctgacagcgcatgcgaagcagtgcaatagcacagggaatgcatgcactctggcaatattctgggttgcttgtttctagctacctgcaaataagtgttcgctactgcttcacgctccatgatgactcgtaacctcatgcatccaccctagctaattcttctgtcaacttcctagccacaccttagggtggtaatgtaccgccacgaaattaagctggaccactgattacaagcaccagtgtggttttgtgctttcagacgtcaggctagctcttaattcgcttaatttttttttcagaacgtatagtacgtaagcacagaacctatagaatataagctgaatagcccctccgattgatcactggccaccagtttggcttcggcgtgacataatggtgagggcttagtcggttgtgggcggcaaaaattataacccaaaaccctgtaaccagaaatggaacccttatccctcactaataatgtaatcaatcagtagtcgctaagcaagccatcattgaggcgatgagctcgccctctcccctgcacgagccgtcgacctcccgcgccccatatatacctcgcctctcccgtcccctcacacaccactctagctagctgtgcacaaagcaagcgcgctcatagcctgagccctgagctgagcaagctaaggtactgatcggc

SEQ ID NO: 471 - DNA, 2810 bp, Setaria italica
ctgacaccaggctttccaaattccaaaccggcaaactgctttgtctcctctaacgtcttatcatgttgagaaatccttaaacctagggataattgtgggctcatatcaaatatactcctaaaaggttaaggctatataaagaaacatgtacccatctattatgataaaagagaacaatttccacctccattatctcctgtgtgcttatcacaggtgacatgctgacaacgatgtgctatcttcccgctcagtgccaggaggcgacctgccctgtcctgcacgactgctgctccagaaagaacacctcgcctctcgttttaatttgccccgacttttttattagaagatgattggaagggaatgagaagaattgagtataaaataaactaattttctctccaatcccttctattacacttcaatctactatccacacaagtactgaacgaaggttgcagagcgccagtcatctcgcttgacatgccccccagttcgctggtatcaggtttctcaacacccgatgatagaggagtactagtagcgtgctagtcagctgtgactcgaggtcagcgctggacagagttcgtatgctcgtaataatttacgctgtagatgtagtggactacagttttcgtgcgctgatcagcctagcgtgacctcgccggagttcacccgtggcgcaccattggctcgccgtccttttccgatcgagcaccaaatctccgcacgcttacacaggccgatcggatcgggacggcccgccgctagctggtcggtatagtagaaccgcccgacgacgtcgccggaaaccagtggacaggacacacacatacagcgcacgccgccgcatatttttatcggcccgtggcaagaatgtaaaccgccacccttgtccggcgctgccagcactgacacaggggatgcatcggggatgaccggggcccgtgacggcgacgcgagccgcccggctcttcacagccacaagggcgcaggtggcagcgccggattggtcggccgccgctcctcgtgtagtcgcgtgtactcgaggccagcgatctggaggccgccgttgagccaggtgtcgcctccgcaggatgcgtatgggcgtggaatgcgtacgtatgttgcgtaggaaaaaaaaggaggttcttcttcttcttacacagcagaggacgaaagactgattcggttcggtactgtgacctttgtggaaatggcggtcagggcaggcgaacgttccgtaaccctccgcttcgttgtcatgcttgtcttcgtcagggggagtgacctgggctggtctcttagctcatcatccggtaaagcgcggactcacagccaatgctaaggacaaacggacaataccgacccttcaattaggtcatgtggatgagtcattgggggaagggatcaggcaatgagaagagaacaaaatcacacaactcgatcagcaggacaactcacacgaacaaattaaagcaaaagccctgatcatgcaaagtactctaatcccaatgatcatctacaagtcttgtggagagttcgtggtcccagaagggtacaggattaggttaggggcgggcgattacatgacgcttgggaacgacagaggacatggcaagctgggctagaaacctctggagttttctttcagaaagaggggcgatgcatggaggaggacagctaatgccgtcgcgctcatccagcttgtagctaggttgcaactaatcgtgccccgcgataagaatctctatttgtacgtagacagggctcgctgcctggctgtgcgtgatgcatgcgacgcaatgattcgctgtccctgttgttcattattggctatcaagtttctgagcatctccattggcggataagtactactccaaattttctttttccagaagataacgctgccgaactgtttagttagtatatccacaccgtattctttgtcatgagctgaataaatgtccatgccaaatgtgtgcctcattttccaactggcaattggcagttggatatgtagcaagcaagggcatgctgacttcagtttagaaacttctggtgacgagtattctttttttggtttaaagaaacaagaagccctgattagttgcttgaagacgatgacagccatgctgacagcgcatgcgaagcagtgcaatagcacagggaatgcatgcactctggcaatattctgggttgcttgtttctagctacctgcaaataagtgttcgctactgcttcacgctccatgatgactcgtaacctcatgcatccaccctagctaattcttctgtcaacttcctagccacaccttagggtggtaatgtaccgccacgaaattaagctggaccactgattacaagcaccagtgtggttttgtgctttcagacgtcaggctagctcttaattcgcttaatttttttttcagaacgtatagtacgtaagcacagaacctatagaatataagctgaatagcccctccgattgatcactggccaccagtttggcttcggcgtgacataatggtgagggcttagtcggttgtgggcggcaaaaattataacccaaaaccctgtaaccagaaatggaacccttatccctcactaataatgtaatcaatcagtagtcgctaagcaagccatcattgaggcgatgagctcgccctctcccctgcacgagccgtcgacctcccgcgccccatatatacctcgcctctcccgtcccctcacacaccactctagctagctgtgcacaaagcaagcgcgctcatagcctgagccctgagctgagcaagctaaggtactgatcgg

SEQ ID NO: 472 - DNA, 2383 bp, Setaria italica
atccacacaagtactgaacgaaggttgcagagcgccagtcatctcgcttgacatgccccccagttcgctggtatcaggtttctcaacacccgatgatagaggagtactagtagcgtgctagtcagctgtgactcgaggtcagcgctggacagagttcgtatgctcgtaataatttacgctgtagatgtagtggactacagttttcgtgcgctgatcagcctagcgtgacctcgccggagttcacccgtggcgcaccattggctcgccgtccttttccgatcgagcaccaaatctccgcacgcttacacaggccgatcggatcgggacggcccgccgctagctggtcggtatagtagaaccgcccgacgacgtcgccggaaaccagtggacaggacacacacatacagcgcacgccgccgcatatttttatcggcccgtggcaagaatgtaaaccgccacccttgtccggcgctgccagcactgacacaggggatgcatcggggatgaccggggcccgtgacggcgacgcgagccgcccggctcttcacagccacaagggcgcaggtggcagcgccggattggtcggccgccgctcctcgtgtagtcgcgtgtactcgaggccagcgatctggaggccgccgttgagccaggtgtcgcctccgcaggatgcgtatgggcgtggaatgcgtacgtatgttgcgtaggaaaaaaaaggaggttcttcttcttcttacacagcagaggacgaaagactgattcggttcggtactgtgacctttgtggaaatggcggtcagggcaggcgaacgttccgtaaccctccgcttcgttgtcatgcttgtcttcgtcagggggagtgacctgggctggtctcttagctcatcatccggtaaagcgcggactcacagccaatgctaaggacaaacggacaataccgacccttcaattaggtcatgtggatgagtcattgggggaagggatcaggcaatgagaagagaacaaaatcacacaactcgatcagcaggacaactcacacgaacaaattaaagcaaaagccctgatcatgcaaagtactctaatcccaatgatcatctacaagtcttgtggagagttcgtggtcccagaagggtacaggattaggttaggggcgggcgattacatgacgcttgggaacgacagaggacatggcaagctgggctagaaacctctggagttttctttcagaaagaggggcgatgcatggaggaggacagctaatgccgtcgcgctcatccagcttgtagctaggttgcaactaatcgtgccccgcgataagaatctctatttgtacgtagacagggctcgctgcctggctgtgcgtgatgcatgcgacgcaatgattcgctgtccctgttgttcattattggctatcaagtttctgagcatctccattggcggataagtactactccaaattttctttttccagaagataacgctgccgaactgtttagttagtatatccacaccgtattctttgtcatgagctgaataaatgtccatgccaaatgtgtgcctcattttccaactggcaattggcagttggatatgtagcaagcaagggcatgctgacttcagtttagaaacttctggtgacgagtattctttttttggtttaaagaaacaagaagccctgattagttgcttgaagacgatgacagccatgctgacagcgcatgcgaagcagtgcaatagcacagggaatgcatgcactctggcaatattctgggttgcttgtttctagctacctgcaaataagtgttcgctactgcttcacgctccatgatgactcgtaacctcatgcatccaccctagctaattcttctgtcaacttcctagccacaccttagggtggtaatgtaccgccacgaaattaagctggaccactgattacaagcaccagtgtggttttgtgctttcagacgtcaggctagctcttaattcgcttaatttttttttcagaacgtatagtacgtaagcacagaacctatagaatataagctgaatagcccctccgattgatcactggccaccagtttggcttcggcgtgacataatggtgagggcttagtcggttgtgggcggcaaaaattataacccaaaaccctgtaaccagaaatggaacccttatccctcactaataatgtaatcaatcagtagtcgctaagcaagccatcattgaggcgatgagctcgccctctcccctgcacgagccgtcgacctcccgcgccccatatatacctcgcctctcccgtcccctcacacaccactctagctagctgtgcacaaagcaagcgcgctcatagcctgagccctgagctgagcaagctaaggtactgatcggc

SEQ ID NO: 473 - DNA, 987 bp, Setaria italica
ctccaaatacagtgctcgttgcaacttgccccagacggccagacttgcggtttggatgattcaggaaagagccacgatataatgacctcatgacagggcgtaatacgctgtgctgcaacaaatttgtaccacgccgttttggtttcaaagaaatgagggatacagccaacgctggcgcacgatacgacatttaggttgcacctaatcaggcacctgataacgatcttaattagcagccagcaagtggttctcggatgtgcctctacgtggtgcttgcctgtccacgctatcattggcaagccaaattgctgattgagtagctctccattggtggagaggggcactccgttgccaggcaaccgatattattttaattaaaaaatcgattttttttgcaggcgcattgtgattatccagtaacaaagtacagcctccatccagcagttggaaacagagggatctagaaactccttggttccgagaaagagaattcgcatggccgttaagcacagaattcgctggtctgtgcggcaagcatagcaactgcatgcatagccacggttcacctcatcgttcaggcgttcacaccgtgcatcatcgttcaccagcccattctcagaagcagacagaaacacacgcatcacaattcacatcgctaatcgtcgctgaatgaagcttagccactgattaaaattagccagcctccccgtattaggcagagccaccggttgggctctagaattatctaacgatgatgagcgctttagtcggtcgcggtcggcaaaattataacccagaagcctccacagccagacgctccgctccgggggggcttatccctgacgaagaaaatcactaaacaatccaatcatgaagaagcagccgcctgttcctgtcacgaaccaccaccgtctctgcttctcactctcactcccggccccttaaatacctcgcctcgcctcggctgcctcgtcacagagctagcta

SEQ ID NO: 474 - DNA, 1501 bp, Setaria italica
tccagatcatttcaaccatgaaggcttataaattatgctgagtgccagcgtcatttcgtgattgctctatccttgtttcctttcgcttatagtaatctgatggtcgtagtgcacccaggtgtcgacctggcacgagcttttcatgactagagaatagagatgtgtgcctctcgttacaggtgagctctgaacaggatagcaaaagtaaaacgagtgaagctccagcttcaattcctgtgatggaatctcgtggaagatttgggacgagatcattgggcgctccctccccctttctgtctcgtgctgttgctgtcttcatccacgaaaagcgtctccagctgctctgttcaccacagcagcatgacaacggcagccactgatgagccctgcagacggttctaggcttctagctccgcggttggaggctcatttcactccgtgatctgaactcgcgctgcgtgcagtttcttgacaaaacttgctgtgacctgatgaaaagcaaggggaaaaggctctccaaatacagtgctcgttgcaacttgccccagacggccagacttgcggtttggatgattcaggaaagagccacgatataatgacctcatgacagggcgtaatacgctgtgctgcaacaaatttgtaccacgccgttttggtttcaaagaaatgagggatacagccaacgctggcgcacgatacgacatttaggttgcacctaatcaggcacctgataacgatcttaattagcagccagcaagtggttctcggatgtgcctctacgtggtgcttgcctgtccacgctatcattggcaagccaaattgctgattgagtagctctccattggtggagaggggcactccgttgccaggcaaccgatattattttaattaaaaaatcgattttttttgcaggcgcattgtgattatccagtaacaaagtacagcctccatccagcagttggaaacagagggatctagaaactccttggttccgagaaagagaattcgcatggccgttaagcacagaattcgctggtctgtgcggcaagcatagcaactgcatgcatagccacggttcacctcatcgttcaggcgttcacaccgtgcatcatcgttcaccagcccattctcagaagcagacagaaacacacgcatcacaattcacatcgctaatcgtcgctgaatgaagcttagccactgattaaaattagccagcctccccgtattaggcagagccaccggttgggctctagaattatctaacgatgatgagcgctttagtcggtcgcggtcggcaaaattataacccagaagcctccacagccagacgctccgctccgggggggcttatccctgacgaagaaaatcactaaacaatccaatcatgaagaagcagccgcctgttcctgtcacgaaccaccaccgtctctgcttctcactctcactcccggccccttaaatacctcgcctcgcctcggctgcctcgtcacagagctagcta

SEQ ID NO: 475 - DNA, 1498 bp, Setaria italica
tccagatcatttcaaccatgaaggcttataaattatgctgagtgccagcgtcatttcgtgattgctctatccttgtttcctttcgcttatagtaatctgatggtcgtagtgcacccaggtgtcgacctggcacgagcttttcatgactagagaatagagatgtgtgcctctcgttacaggtgagctctgaacaggatagcaaaagtaaaacgagtgaagctccagcttcaattcctgtgatggaatctcgtggaagatttgggacgagatcattgggcgctccctccccctttctgtctcgtgctgttgctgtcttcatccacgaaaagcgtctccagctgctctgttcaccacagcagcatgacaacggcagccactgatgagccctgcagacggttctaggcttctagctccgcggttggaggctcatttcactccgtgatctgaactcgcgctgcgtgcagtttcttgacaaaacttgctgtgacctgatgaaaagcaaggggaaaaggctctccaaatacagtgctcgttgcaacttgccccagacggccagacttgcggtttggatgattcaggaaagagccacgatataatgacctcatgacagggcgtaatacgctgtgctgcaacaaatttgtaccacgccgttttggtttcaaagaaatgagggatacagccaacgctggcgcacgatacgacatttaggttgcacctaatcaggcacctgataacgatcttaattagcagccagcaagtggttctcggatgtgcctctacgtggtgcttgcctgtccacgctatcattggcaagccaaattgctgattgagtagctctccattggtggagaggggcactccgttgccaggcaaccgatattattttaattaaaaaatcgattttttttgcaggcgcattgtgattatccagtaacaaagtacagcctccatccagcagttggaaacagagggatctagaaactccttggttccgagaaagagaattcgcatggccgttaagcacagaattcgctggtctgtgcggcaagcatagcaactgcatgcatagccacggttcacctcatcgttcaggcgttcacaccgtgcatcatcgttcaccagcccattctcagaagcagacagaaacacacgcatcacaattcacatcgctaatcgtcgctgaatgaagcttagccactgattaaaattagccagcctccccgtattaggcagagccaccggttgggctctagaattatctaacgatgatgagcgctttagtcggtcgcggtcggcaaaattataacccagaagcctccacagccagacgctccgctccgggggggcttatccctgacgaagaaaatcactaaacaatccaatcatgaagaagcagccgcctgttcctgtcacgaaccaccaccgtctctgcttctcactctcactcccggccccttaaatacctcgcctcgcctcggctgcctcgtcacagagctag

SEQ ID NO: 476 - DNA, 2197 bp, Setaria italica
actcctatctactgctctatttttctaagtgaatgaaaaatctccaaacctttatttgaccagctgtttttttttcacatttccctgcaactattacattcggctattcattaacgcatacagcgtatgtttcacattaacatgtgcagaaacgctggggaccacggggtggaagttcaatgcctgggctgctgtaatttgcttactagcctatcttttgaactagcctggaactatacttcgatcacacaagcagtgcatgggatgttattcaccagcccattttttgttagattttggctggttactgatatcctttgctgtcttgcacctgttctgaagtgctgttatccgttgctcattaaattgaaaatgtggaaactcattggacgcaagtttgcaatttgtatactgtgtgtccgagagctgctctgttggcacgcaattcttttaacatctattttttttcccttactggctggtttcttcttggatgggaaactgtagacgttgggcagcgtgcgatgctgcaatactcatcaggatccggttgtctgtatgcatatgcacaaccaaattctctccttgtgtgatcaaaatgagctgaagaagagaatctgttgtgcggcattgacgaagagctcagtcagttgcagaaatccatcaaaccaaccggcgtgattaggacccgagccgtccagatcatttcaaccatgaaggcttataaattatgctgagtgccagcgtcatttcgtgattgctctatccttgtttcctttcgcttatagtaatctgatggtcgtagtgcacccaggtgtcgacctggcacgagcttttcatgactagagaatagagatgtgtgcctctcgttacaggtgagctctgaacaggatagcaaaagtaaaacgagtgaagctccagcttcaattcctgtgatggaatctcgtggaagatttgggacgagatcattgggcgctccctccccctttctgtctcgtgctgttgctgtcttcatccacgaaaagcgtctccagctgctctgttcaccacagcagcatgacaacggcagccactgatgagccctgcagacggttctaggcttctagctccgcggttggaggctcatttcactccgtgatctgaactcgcgctgcgtgcagtttcttgacaaaacttgctgtgacctgatgaaaagcaaggggaaaaggctctccaaatacagtgctcgttgcaacttgccccagacggccagacttgcggtttggatgattcaggaaagagccacgatataatgacctcatgacagggcgtaatacgctgtgctgcaacaaatttgtaccacgccgttttggtttcaaagaaatgagggatacagccaacgctggcgcacgatacgacatttaggttgcacctaatcaggcacctgataacgatcttaattagcagccagcaagtggttctcggatgtgcctctacgtggtgcttgcctgtccacgctatcattggcaagccaaattgctgattgagtagctctccattggtggagaggggcactccgttgccaggcaaccgatattattttaattaaaaaatcgattttttttgcaggcgcattgtgattatccagtaacaaagtacagcctccatccagcagttggaaacagagggatctagaaactccttggttccgagaaagagaattcgcatggccgttaagcacagaattcgctggtctgtgcggcaagcatagcaactgcatgcatagccacggttcacctcatcgttcaggcgttcacaccgtgcatcatcgttcaccagcccattctcagaagcagacagaaacacacgcatcacaattcacatcgctaatcgtcgctgaatgaagcttagccactgattaaaattagccagcctccccgtattaggcagagccaccggttgggctctagaattatctaacgatgatgagcgctttagtcggtcgcggtcggcaaaattataacccagaagcctccacagccagacgctccgctccgggggggcttatccctgacgaagaaaatcactaaacaatccaatcatgaagaagcagccgcctgttcctgtcacgaaccaccaccgtctctgcttctcactctcactcccggccccttaaatacctcgcctcgcctcggctgcctcgtcacagagctagcta

SEQ ID NO: 477 - DNA, 654 bp, Setaria italica; identical to SEQ ID NO: 79

SEQ ID NO: 478 - DNA, 2722 bp, Setaria italica
ccatctctccttgaaagagaactatgtttaagtttcaacaagagacaacaatgcccttgtgaactgacaaaagagataacaggaaaagacaaggattcgaggaagcaagaaggcaagtgagcagtgaattgcagtactaccgaacaagactgatttttagtacagtacctaattattttggaataatgaataagagaggataatgttggacgaataaaaattgtgaacggaaaataactagatatgttttgggaggcactaacaagactttaatttggaagagagatacaaacatataaacatgttagtggatagataatatggtgtcttatgttagaaaagtacattattttttatggttattttcatagatctggaacattaatacaaaactaatcctatggatacaaaactgcatgaaaagtaatcatgaatttattctaatattgggcatcatatttaagtcacgttgcagaatttgaacttaaaactcgattcgtacgtggagaaaacaaaaaagatcaaatctcattagaggtatattggaccatttaaagtagtttgggggaataaatcgagcctaagttttatttaggggttaagaggacagataaagtagattggtgatggtagtaaaatggacattttcctagttgtatctggtatgtactatttggcttaacatatattaagtcccaagtagtgcaaattgggattcaaatactaaattctctttacgtagagatgaggaaggagaattacaaagcagcattgccacagccttgcttcagttttgctcgatgcaagcagggtggagtggtggacaggcatggactagcggcacggaagacaacatcatgcatgtgcttccagagttgccaacggcaaaagagcagcaatgtgtgtagttcggccatgggctcggtcacaggtgggttcgtctcccagaacaggcaggagagggggtagctggctgagcatccatccgtgatgagcctaaaccgttgcgcaaacgggcagctggagagataatgcgaatatgtgatcctccacggcgttgccacagatgtcacggatcatgcatgcatgtcgtcatttagcagatgtttgagtctgatacacccttcacaccaagcaaattataaccaagataaggattcgaggaagcagaaggaggcaagtgagcagtgacaagtacgtccacaacacaatccagacgaaaacgaacacatcaatgccctcggcgccaatcgtagtaatgctgcaacaaacaaagtcctgtgaagacggtctctattaaatagccacacatggagccgatatataatccgaaagataatgtaataatagagaagcgtcatgttttttcaaaaataaaaataaaaataaactgggaacaagcccatcgcaaggccgggagcgagcttgcttttcagagtcagtgagccaccgggcgggagctgacgggtaggggaagaggaagacaacatcgtgcatgtgcttcaagagttgccaacggcaaaggagcagcagtgtgtgtagttcggctatgggctcagtcacaggtgggtttcgtctcccagaaccagcaggagagggggtttgtggctggctgtgcatccatccgtgatgagcctaaaccgttgcgcaaatggacacctggagcgataatgtgaatatgtgatcctccacggcgttgccacaaatgtcactgatcatccatgttgtcctatagcacatgcttgagtccaagtccctccacaccaagcaaattatagccaagacaaggattcaaggaagcaagaaggcgagtgagcagtgacaaagtatgtccacagcacaatccgtacgaaaacgagcgcatcagtgccctcagcgccaatcgtagtgtttccgcatcaaataagtcctgtgaagccggtctctattaaattgccacgtatgaagccgatgtgtggtccgaaagataatatgcaataatagagaagcgttatgttttccctgaaaaaaacctgggaacaagcctgtcgcaaggccgggagcctcgcttccgtcttgctttttcacagtcagtgagccaccgggcgggagctgacgggtaggggaagaggaagacagcaccgtgcatgtgcttccagagttgccaacggcaaatgagcagcagtgtgtgtagttcggccatgggctcggtcacaggtgggtttcgtctcccagaaccagcaggagagggggtatgtggctggctgtgcatccatccgtgatgagcctaaaccgttgcgcaaacggacacctagagcgataatgtatatgtgatcctccacggcgttgccacaaatgtcactgatcatgcatgttgtcctatatagcacatgcttgagtccaagtccctccacaccaagcaaattaattatagccaagagaaggattcgaggaagaagaaggcgattgagcagtgacaagtacgtcgacagcacaacccagacgaaaaccaggcaacgagcacatcgctccgcagcgctgcccctcggccctccccttgcattcgtgattcgccgccggtcacatgccctccgcttgaaaaaaaaaaagccccctttccatccgccatgaggcgtgcaatcccgtgcacacactcgccgactccccatccgttattttgttttttttagaagccccatccgttatttaaacccacccgcgcgcctcgctcgacctcgtgcca

SEQ ID NO: 479 - DNA, 2723 bp, Setaria italica
ccatctctccttgaaagagaactatgtttaagtttcaacaagagacaacaatgcccttgtgaactgacaaaagagataacaggaaaagacaaggattcgaggaagcaagaaggcaagtgagcagtgaattgcagtactaccgaacaagactgatttttagtacagtacctaattattttggaataatgaataagagaggataatgttggacgaataaaaattgtgaacggaaaataactagatatgttttgggaggcactaacaagactttaatttggaagagagatacaaacatataaacatgttagtggatagataatatggtgtcttatgttagaaaagtacattattttttatggttattttcatagatctggaacattaatacaaaactaatcctatggatacaaaactgcatgaaaagtaatcatgaatttattctaatattgggcatcatatttaagtcacgttgcagaatttgaacttaaaactcgattcgtacgtggagaaacaaaaaagatcaaatctcattagaggtatattggaccatttaaagtagtttgggggaataaatcgagcctaagttttatttaggggttaagaggacagataaagtagattggtgatggtagtaaaatggacattttcctagttgtatctggtatgtactatttggcttaacatatattaagtcccaagtagtgcaaattgggattcaaatactaaattctctttacgtagagatgaggaaggagaattacaaagcagcattgccacagccttgcttcagttttgctcgatgcaagcagggtggagtggtggacaggcatggactagcggcacggaagacaacatcatgcatgtgcttccagagttgccaacggcaaaagagcagcaatgtgtgtagttcggccatgggctcggtcacaggtgggttcgtctcccagaacaggcaggagagggggtagctggctgagcatccatccgtgatgagcctaaaccgttgcgcaaacgggcagctggagagataatgcgaatatgtgatcctccacggcgttgccacagatgtcacggatcatgcatgcatgtcgtcatttagcagatgtttgagtctgatacacccttcacaccaagcaaattataaccaagataaggattcgaggaagcagaaggaggcaagtgagcagtgacaagtacgtccacaacacaatccagacgaaaacgaacacatcaatgccctcggcgccaatcgtagtaatgctgcaacaaacaaagtcctgtgaagacggtctctattaaatagccacacatggagccgatatataatccgaaagataatgtaataatagagaagcgtcatgttttttcaaaaataaaaataaaaataaactgggaacaagcccatcgcaaggccgggagcgagcttgcttttcagagtcagtgagccaccgggcgggagctgacgggtaggggaagaggaagacaacatcgtgcatgtgcttcaagagttgccaacggcaaaggagcagcagtgtgtgtagttcggctatgggctcagtcacaggtgggtttcgtctcccagaaccagcaggagagggggtttgtggctggctgtgcatccatccgtgatgagcctaaaccgttgcgcaaatggacacctggagcgataatgtgaatatgtgatcctccacggcgttgccacaaatgtcactgatcatccatgttgtcctatagcacatgcttgagtccaagtccctccacaccaagcaaattatagccaagacaaggattcaaggaagcaagaaggcgagtgagcagtgacaaagtatgtccacagcacaatccgtacgaaaacgagcgcatcagtgccctcagcgccaatcgtagtgtttccgcatcaaataagtcctgtgaagccggtctctattaaattgccacgtatgaagccgatgtgtggtccgaaagataatatgcaataatagagaagcgttatgttttccctgaaaaaaacctgggaacaagcctgtcgcaaggccgggagcctcgcttccgtcttgctttttcacagtcagtgagccaccgggcgggagctgacgggtaggggaagaggaagacagcaccgtgcatgtgcttccagagttgccaacggcaaatgagcagcagtgtgtgtagttcggccatgggctcggtcacaggtgggtttcgtctcccagaaccagcaggagagggggtatgtggctggctgtgcatccatccgtgatgagcctaaaccgttgcgcaaacggacacctagagcgataatgtatatgtgatcctccacggcgttgccacaaatgtcactgatcatgcatgttgtcctatatagcacatgcttgagtccaagtccctccacaccaagcaaattaattatagccaagagaaggattcgaggaagaagaaggcgattgagcagtgacaagtacgtcgacagcacaacccagacgaaaaccaggcaacgagcacatcgctccgcagcgctgcccctcggccctccccttgcattcgtgattcgccgccggtcacatgccctccgcttgaaaaaaaaaaaagccccctttccatccgccatgaggcgtgcaatcccgtgcacacactcgccgactccccatccgttattttgttttttttagaagccccatccgttatttaaacccacccgcgcgcctcgctcgacctcgtgccac

SEQ ID NO: 480 - DNA, 2722 bp, Setaria italica
  misc_feature (509)..(509): w= a or t.
ccatctctccttgaaagagaactatgtttaagtttcaacaagagacaacaatgcccttgtgaactgacaaaagagataacaggaaaagacaaggattcgaggaagcaagaaggcaagtgagcagtgaattgcagtactaccgaacaagactgatttttagtacagtacctaattattttggaataatgaataagagaggataatgttggacgaataaaaattgtgaacggaaaataactagatatgttttgggaggcactaacaagactttaatttggaagagagatacaaacatataaacatgttagtggatagataatatggtgtcttatgttagaaaagtacattattttttatggttattttcatagatctggaacattaatacaaaactaatcctatggatacaaaactgcatgaaaagtaatcatgaatttattctaatattgggcatcatatttaagtcacgttgcagaatttgaacttaaaactcgattcgtacgtggagwaaacaaaaaagatcaaatctcattagaggtatattggaccatttaaagtagtttgggggaataaatcgagcctaagttttatttaggggttaagaggacagataaagtagattggtgatggtagtaaaatggacattttcctagttgtatctggtatgtactatttggcttaacatatattaagtcccaagtagtgcaaattgggattcaaatactaaattctctttacgtagagatgaggaaggagaattacaaagcagcattgccacagccttgcttcagttttgctcgatgcaagcagggtggagtggtggacaggcatggactagcggcacggaagacaacatcatgcatgtgcttccagagttgccaacggcaaaagagcagcaatgtgtgtagttcggccatgggctcggtcacaggtgggttcgtctcccagaacaggcaggagagggggtagctggctgagcatccatccgtgatgagcctaaaccgttgcgcaaacgggcagctggagagataatgcgaatatgtgatcctccacggcgttgccacagatgtcacggatcatgcatgcatgtcgtcatttagcagatgtttgagtctgatacacccttcacaccaagcaaattataaccaagataaggattcgaggaagcagaaggaggcaagtgagcagtgacaagtacgtccacaacacaatccagacgaaaacgaacacatcaatgccctcggcgccaatcgtagtaatgctgcaacaaacaaagtcctgtgaagacggtctctattaaatagccacacatggagccgatatataatccgaaagataatgtaataatagagaagcgtcatgttttttcaaaaataaaaataaaaataaactgggaacaagcccatcgcaaggccgggagcgagcttgcttttcagagtcagtgagccaccgggcgggagctgacgggtaggggaagaggaagacaacatcgtgcatgtgcttcaagagttgccaacggcaaaggagcagcagtgtgtgtagttcggctatgggctcagtcacaggtgggtttcgtctcccagaaccagcaggagagggggtttgtggctggctgtgcatccatccgtgatgagcctaaaccgttgcgcaaatggacacctggagcgataatgtgaatatgtgatcctccacggcgttgccacaaatgtcactgatcatccatgttgtcctatagcacatgcttgagtccaagtccctccacaccaagcaaattatagccaagacaaggattcaaggaagcaagaaggcgagtgagcagtgacaaagtatgtccacagcacaatccgtacgaaaacgagcgcatcagtgccctcagcgccaatcgtagtgtttccgcatcaaataagtcctgtgaagccggtctctattaaattgccacgtatgaagccgatgtgtggtccgaaagataatatgcaataatagagaagcgttatgttttccctgaaaaaaacctgggaacaagcctgtcgcaaggccgggagcctcgcttccgtcttgctttttcacagtcagtgagccaccgggcgggagctgacgggtaggggaagaggaagacagcaccgtgcatgtgcttccagagttgccaacggcaaatgagcagcagtgtgtgtagttcggccatgggctcggtcacaggtgggtttcgtctcccagaaccagcaggagagggggtatgtggctggctgtgcatccatccgtgatgagcctaaaccgttgcgcaaacggacacctagagcgataatgtatatgtgatcctccacggcgttgccacaaatgtcactgatcatgcatgttgtcctatatagcacatgcttgagtccaagtccctccacaccaagcaaattaattatagccaagagaaggattcgaggaagaagaaggcgattgagcagtgacaagtacgtcgacagcacaacccagacgaaaaccaggcaacgagcacatcgctccgcagcgctgcccctcggccctccccttgcattcgtgattcgccgccggtcacatgccctccgcttgaaaaaaaaaaagccccctttccatccgccatgaggcgtgcaatcccgtgcacacactcgccgactccccatccgttattttgttttttttagaagccccatccgttatttaaacccacccgcgcgcctcgctcgacctcgtgcca

SEQ ID NO: 481 - DNA, 1879 bp, Setaria italica
cacggaagacaacatcatgcatgtgcttccagagttgccaacggcaaaagagcagcaatgtgtgtagttcggccatgggctcggtcacaggtgggttcgtctcccagaacaggcaggagagggggtagctggctgagcatccatccgtgatgagcctaaaccgttgcgcaaacgggcagctggagagataatgcgaatatgtgatcctccacggcgttgccacagatgtcacggatcatgcatgcatgtcgtcatttagcagatgtttgagtctgatacacccttcacaccaagcaaattataaccaagataaggattcgaggaagcagaaggaggcaagtgagcagtgacaagtacgtccacaacacaatccagacgaaaacgaacacatcaatgccctcggcgccaatcgtagtaatgctgcaacaaacaaagtcctgtgaagacggtctctattaaatagccacacatggagccgatatataatccgaaagataatgtaataatagagaagcgtcatgttttttcaaaaataaaaataaaaataaactgggaacaagcccatcgcaaggccgggagcgagcttgcttttcagagtcagtgagccaccgggcgggagctgacgggtaggggaagaggaagacaacatcgtgcatgtgcttcaagagttgccaacggcaaaggagcagcagtgtgtgtagttcggctatgggctcagtcacaggtgggtttcgtctcccagaaccagcaggagagggggtttgtggctggctgtgcatccatccgtgatgagcctaaaccgttgcgcaaatggacacctggagcgataatgtgaatatgtgatcctccacggcgttgccacaaatgtcactgatcatccatgttgtcctatagcacatgcttgagtccaagtccctccacaccaagcaaattatagccaagacaaggattcaaggaagcaagaaggcgagtgagcagtgacaaagtatgtccacagcacaatccgtacgaaaacgagcgcatcagtgccctcagcgccaatcgtagtgtttccgcatcaaataagtcctgtgaagccggtctctattaaattgccacgtatgaagccgatgtgtggtccgaaagataatatgcaataatagagaagcgttatgttttccctgaaaaaaacctgggaacaagcctgtcgcaaggccgggagcctcgcttccgtcttgctttttcacagtcagtgagccaccgggcgggagctgacgggtaggggaagaggaagacagcaccgtgcatgtgcttccagagttgccaacggcaaatgagcagcagtgtgtgtagttcggccatgggctcggtcacaggtgggtttcgtctcccagaaccagcaggagagggggtatgtggctggctgtgcatccatccgtgatgagcctaaaccgttgcgcaaacggacacctagagcgataatgtatatgtgatcctccacggcgttgccacaaatgtcactgatcatgcatgttgtcctatatagcacatgcttgagtccaagtccctccacaccaagcaaattaattatagccaagagaaggattcgaggaagaagaaggcgattgagcagtgacaagtacgtcgacagcacaacccagacgaaaaccaggcaacgagcacatcgctccgcagcgctgcccctcggccctccccttgcattcgtgattcgccgccggtcacatgccctccgcttgaaaaaaaaaaaagccccctttccatccgccatgaggcgtgcaatcccgtgcacacactcgccgactccccatccgttattttgttttttttagaagccccatccgttatttaaacccacccgcgcgcctcgctcgacctcgtg

SEQ ID NO: 482 - DNA, 1761 bp, Setaria italica
aactgctactagcagcacaagcattctttatttttattaacaataatttctacaacatgtcattacaaatattttattcgcgagatgcgagggcacgccaaggcccggagtctcgaggaggacgacatcgtgagatgaatgcatatgtctccttgtgttgcaaggtcacgaatggaagtatacttgctagggctcatcttgttcttcgacgagtggacgaggactcgaggagtccagctgcggactgcttcggcagacggacaccacgaaggacgtaccctccttccaaccactggtctgttttatccaagatctgagatcaagacgaaacataactatggttgcagcttcaattctttgcaaccgctgagtgcaaaacattttatgctgatgtaataatttctatgagaaacgataattacgatgcttatgtgtgagcttgccatatgtgcaattaatgctttattttttaagaaaataatatcttttctatggcaattttatccccacaatattagcccgtagcaatgcacaggcactatccctgtacgtatataaacgactatagctaattgaaatggcggagtatgccttggacccaccttactgctagttgaatcggcgaaattttccttctctaagcagcacatcttaaaaaaatataggaactgtttggctgcacagcactgcagctacagctgctgctgccagcgttttagcctactgtagcggttgcagcaaggctgcatgctagcagcccgaaagtagcacagctaaacaggcccaaaactttttcatatgaattttagatccgaacattgtgtcgattatttgagtatcaagatggttccaaataaaaaaatatgaactacaaagttgtacaatgtttatataaagtttatatttgtctaagttcatatgaaaaagttatatattttttttaaaaaatgtgctgctcagagaaagagaattccaccgattcaactggcggtaaggtcataaattccgttgtttcggttagatagccaattcaaatgtctatatgagtatagatttgcaaacttttattagaacatatatttttacaaaacattaaaaatactttttacaaaacatatagatttgcaaacttttattagctggctgctgcagctgcagccagccgaaagcagcacagccgaacatgcccataactttttcatatgaatcttaatctgaacattgtgttgattatttgaatactaagatagtttcaaataaaaaagtatgaactaccaagttgtacaatatttatataaagtttatctctttttgtgtttgcattcgtatgaaaaagttatatttttttgaaaaaaatgtgctgctcaaagaactggcggtaaggtcataaattccgctgtttcggttggatagccaattcaaatgtctatatgagtacagatttgcaaatttttattagaacatatatttttgcaagacattaaaaataaaagacatataaaaacaaaacataatcaactttccttgaagccacaccactcgccgcagccgcgctctcaaatttcctggagccagaagcgtcggggtccggagccagacgggcggcagacgcggccgggaaggtggggccccacagggataaggtgcgatgggggcgcgtgtgaaccccgtcgcgccacctgacggtgcgccacaggtacggtactgtatattccaacctgccgttcgtctcccatttcccgcgaactcacttgcctcgcg

SEQ ID NO: 483 - DNA, 1682 bp, Setaria italica
taatgcatatggttagacttcatagcatgcgttatgtaattatggtgattagatctagtatgtcaacccttcatgatatataaacacgttcacctatgttcgtgcccgtaaactacctacaccgataggggggtcgtgacaaggtctgtttccgtgtagggtgggggttttcgggaggttgaccggaggtagtagtttaaagattgctttggatgagatgcatgatgtgtttgctcgttggctagaactacaactagaagatatagccaattacaactagaagatgataggctcttgctatccttggtggtcttataccatatatatctgtggatgtgatatacccttattcatgatatcaatctttataacaagtttgccttcatatacaatcaatgcatcatgttaggattgcaccgttagattagatggaagatcctagttagttcgctgccgatccacggattgataaacattagacgaatactctaagggaaaagctatgatgatccgtgcatttgcggttcacaaattgacgcgctaactgccgtcaacaaacttcaacaagtaacagtgggaaacaaatgcggtagaagtgaagcaggaagaagatcgaggctttctagcaagagttttctttgggagtgagtggagagcattgcatcgttctaggtttgtttgtggaaaagtgcatggaaatgtatcaaaccctgcaggatttgaattgacacttgttcagtagtcaaaggtggtcccactatcttgtaatatgtctcgtgattcaacatttgaaaacaagatatgtaactggatatttctccaaccattcaaaacaagcctcaccaaatagaactctggtagataacttgtctcacaaggcttaaggtaccaacaatggttcaaaattaaatgtgacagataagtcgtccgatacgagcatttttgtagcagtgatggatcctatgtaagtctacgatgaacctatatagtagcttgatatgctagctttggtatttacctctttaaacatgttcatgtaatgaacagtctattttattagctagactcgaaataaatctcgacaataacttgtaggaataatatcttatggtgttttgtactaaaagcactgactactaattaataatccaagcatcctaatttgttaaggaaagtccaaaatgttacatgtattctttatgaatgtagcacaaagtattctttatgaatgtagcacaaaggataagacatgatatgggtgagtcaaggccacctaggcaacaaacaatacagaaggtagagtattaaaaatgaccacccaagcttatgtggattagacgagccaaaattatcatgccagcgtcatccatatcaagataggaacaaaaaaaaccatgtcttatgatgtaatacctccatttttatttatatgtcattttggttaccaccacggacgtcaaacaaacaaaaatggaggtaataacaaaatcaattaaaacaaaaaggccatgtcttctgatgtagcaaaatgaattttataacttcagctggtatccaaatcgacaaatgacatgtcatgtccagattatgaggcatcctccaaaattcagttttgcaaaggccaaaatcctacatgcatggcttggctcctataaataccaccccaatcaatctctaaccca

SEQ ID NO: 484 - DNA, 1739 bp, Setaria italica
  misc_feature (402)..(402): r= g or a.
tactatagggcacgcgtggtcgacggcccgggctggtccatgccaaacatgaggatggcatgcaccgtaaagttgatgatgaacacttcttaggcagtctttcaggggagagaagaacttcaactagccactgcaaaataactataacattcaattgaggggcttggtagcacttgaaatgggtctctttcaaccctcacttcactatcttgatatattcccttgtcgaggcgagatcgatgccttcacaatctttctactgctcattaaaaacttgggagctcgccaagcaactcctagctagccatctaggaggattaaccactgctctcaaccccgtgatcgcacttgctttcagaatgccaacaggtagtgtcgtaggaagatgtatccgagcattarctaccaacagaaaaagatgatggaatactcagaatcttcaaaaaagtcattgtaacatgaaatcaaagtttagttttgcatttataaaattatagcctatcaacttctaacaccaatcggatgcaaacctaagtgtaggacgaaatcggaatatactgccttcaacccaaatccccaattccagaggctcaagtctttgccacagccaataggagtgtgccagcgagtcccttgcactgtacgccattgcagatatacctattgctctagactgcaatgggaaagtggaccacacttattagaactgtaatctcaaaaagctaccttgttcaaaaatcataatctgcattatgtctcaatggtagtgctgactcgtcagaatcaagaggtcacaggttcgacccctgctctaaacactcttacctttttttattttcctccctttcttatcacagactaacttgtgggaccctgctagattttacaatgaattggaacactttatttctcaactcatgcttgcatgggggatcccccttggtttatgactttttgcacaccttatttttcaacaaatgcttacatgtggaatcctggttggtttatgacgttttcatggaccttatattgtcacaaaaccaccatgtaacaacgagtgacgatttctttttggctacagtggcaactttatgacgttccgtaactttgtcactaaatttgctcggatgtgaaactttatgacgtttttagccagaaacatcatagaactatgacgagaacaaatgtgtcataaaattttcgtcatagatcaacacatttcttgtagtgtaatcaactgtctatcttagctaaactcaaaataaatcttgacaataactattgtatgaatcatatcttgtggtattttataaaaaaactatgaatattaattaataatctaagcatcataatgtgttaagaaaaatccaaaatgatacatgtttgctttatgaatgtagcacaaagtattaaggacaagacaagtatgggtgagtcaaggccacctaagcaactaacaatacaaaaagcatacttaaaaaaaaggccacccaagctgatgtggctttgacgagccaaactaatcatgacaccctcatccatatcaagatagaaacaaaaaggccatgtcttctgatgtagcaaaatgagttttataacttcggctggtatccaaatcgacaaatgacatgtcatgtccagattatgaggcatcctccaacattcagttttgcaaaggccaaaatcctacatgcatggcttggctactataaataccaccccaatcaatctctaaccca

SEQ ID NO: 485 - DNA, 1681 bp, Setaria italica
  misc_feature (344)..(344): r= g or a.
catgcaccgtaaagttgatgatgaacacttcttaggcagtctttcaggggagagaagaacttcaactagccactgcaaaataactataacattcaattgaggggcttggtagcacttgaaatgggtctctttcaaccctcacttcactatcttgatatattcccttgtcgaggcgagatcgatgccttcacaatctttctactgctcattaaaaacttgggagctcgccaagcaactcctagctagccatctaggaggattaaccactgctctcaaccccgtgatcgcacttgctttcagaatgccaacaggtagtgtcgtaggaagatgtatccgagcattarctaccaacagaaaaagatgatggaatactcagaatcttcaaaaaagtcattgtaacatgaaatcaaagtttagttttgcatttataaaattatagcctatcaacttctaacaccaatcggatgcaaacctaagtgtaggacgaaatcggaatatactgccttcaacccaaatccccaattccagaggctcaagtctttgccacagccaataggagtgtgccagcgagtcccttgcactgtacgccattgcagatatacctattgctctagactgcaatgggaaagtggaccacacttattagaactgtaatctcaaaaagctaccttgttcaaaaatcataatctgcattatgtctcaatggtagtgctgactcgtcagaatcaagaggtcacaggttcgacccctgctctaaacactcttacctttttttattttcctccctttcttatcacagactaacttgtgggaccctgctagattttacaatgaattggaacactttatttctcaactcatgcttgcatgggggatcccccttggtttatgactttttgcacaccttatttttcaacaaatgcttacatgtggaatcctggttggtttatgacgttttcatggaccttatattgtcacaaaaccaccatgtaacaacgagtgacgatttctttttggctacagtggcaactttatgacgttccgtaactttgtcactaaatttgctcggatgtgaaactttatgacgtttttagccagaaacatcatagaactatgacgagaacaaatgtgtcataaaattttcgtcatagatcaacacatttcttgtagtgtaatcaactgtctatcttagctaaactcaaaataaatcttgacaataactattgtatgaatcatatcttgtggtattttataaaaaaactatgaatattaattaataatctaagcatcataatgtgttaagaaaaatccaaaatgatacatgtttgctttatgaatgtagcacaaagtattaaggacaagacaagtatgggtgagtcaaggccacctaagcaactaacaatacaaaaagcatacttaaaaaaaaggccacccaagctgatgtggctttgacgagccaaactaatcatgacaccctcatccatatcaagatagaaacaaaaaggccatgtcttctgatgtagcaaaatgagttttataacttcggctggtatccaaatcgacaaatgacatgtcatgtccagattatgaggcatcctccaacattcagttttgcaaaggccaaaatcctacatgcatggcttggctactataaataccaccccaatcaatctctaaccca

SEQ ID NO: 486 - DNA, 513 bp, Setaria italica
cctttcttttcttttccttttccttcctgcctttggccgatgtccctttgcctttacatccatgcacagataataaatctactgcacacaaaagaagatgctgatagaataacttggccactggggaacaagggtatttggtaggtacctcttcgaagcccatacatactctactggtcgctgcagcagacggtgtggtggccagaataacagctacctaggcccgtcgcgtgtctacacctgcatctatctgctcagctcaacgaattatattgccacgccccaccggcgatcaaaagctgcaaaaggcaaagaagcttcaaggagatggccagtgacaccaccctgtatatcagactgcttgtcccacaaaatatttgtttgtcccaagaataagctcacatgttgctcaaggcagctggatagctacgcaagaaacccttgggcaggctacgccccctctttccctggcttatataaaccctgccctacgtcccatcagcatcattgcag

SEQ ID NO: 487 - DNA, 1574 bp, Setaria italica
gtcagtgaccggagtaccggacacccgagttgggaacgctcaaagcaaggatctccgaacgctatgttgggcttgggtgggctcgggccctaagctaggagcctaaaacgcacaaccccaaactacatttgccaggcacacagaccagcccaatatctttgaggctgatcacatttcttagcatccctccaatcacaaataactgatttattaaaaaaatcacagtgtagtcaatgcatcaatatctctttaaatatttcaaattggattttagaaatattattttggcatatttttgcatgtgtttcatactagtaatcaattgtcaaattaatgcttcatacttgttatttgtgaaggaaaggaaaagttcttgtttgttatgcattttccctatctcttttttggataatgaataatatttcgactaactgtggatatacttcatgtacaccattaagttaaaagcagagatgcttgcacaaacgcacacaaaatctattcctatgagcatgcacctcggagagaatgagctggccaatcttacgttgttgtcgatgacatgttgcctagaataaatttagaaaaaaatattagcatccataccgagtcaaggacttaaatacaggtgagcaagcttcaccataaggaacctaaccagctgagctgttgagtccgttgttgatgttggctccatctaaatacatttgcttgttattcgatcaaacattagcaacttttagctacaagattatatgccatgagattagtgtgctcctcgaaccaatgctctcctgatcatgagagatatttaaagggaccatacataacacataggttaagattgtacaaagatggatattgattgatgcataaaaggcttcattatcaaatcatttgccgtccaaaactgaattcgattactatcattcaattgaaagggaccctcacattactaaataactttataaaaaaaactctgcttttgaatgtctaaattttttgttcatagccctccattaaactccacttagctttaaatttcttcatcaaaattgttgcttttggcgctagagaaaaaaaaaatactttgcctttaccaacgtggccttgagactagcgtcttctgcatcatacaccgtcgacgtgtgtcggtcggctgtcacgacaaaagcaaaactccactgcccctgcaaaatgaacatgttgggagattatttaagcctgagccttttaggtgacaaagccaagctaatgcgcaggtgcgagcattatacaagcgcgccgcgaccctttgcctagtgctgtccgttctgtacgtgtacctgagctggtcagctccacatgcacaagtgtataggttgtacttaccctgcctaaagcttaatggaggaggtgagatcagagctggaaagaccagccatattaccggctccctcgcccaatcctcataactaatcagtttagaaattagcttaccagatcatgcttatcattccatttaattcatgcttggttacgttcgtcctataaatacgtgttcgtcttctcatctcgtcagatcagcacgaagc

SEQ ID NO: 488 - DNA, 1545 bp, Setaria italica
ttgggaacgctcaaagcaaggatctccgaacgctatgttgggcttgggtgggctcgggccctaagctaggagcctaaaacgcacaaccccaaactacatttgccaggcacacagaccagcccaatatctttgaggctgatcacatttcttagcatccctccaatcacaaataactgatttattaaaaaaatcacagtgtagtcaatgcatcaatatctctttaaatatttcaaattggattttagaaatattattttggcatatttttgcatgtgtttcatactagtaatcaattgtcaaattaatgcttcatacttgttatttgtgaaggaaaggaaaagttcttgtttgttatgcattttccctatctcttttttggataatgaataatatttcgactaactgtggatatacttcatgtacaccattaagttaaaagcagagatgcttgcacaaacgcacacaaaatctattcctatgagcatgcacctcggagagaatgagctggccaatcttacgttgttgtcgatgacatgttgcctagaataaatttagaaaaaaatattagcatccataccgagtcaaggacttaaatacaggtgagcaagcttcaccataaggaacctaaccagctgagctgttgagtccgttgttgatgttggctccatctaaatacatttgcttgttattcgatcaaacattagcaacttttagctacaagattatatgccatgagattagtgtgctcctcgaaccaatgctctcctgatcatgagagatatttaaagggaccatacataacacataggttaagattgtacaaagatggatattgattgatgcataaaaggcttcattatcaaatcatttgccgtccaaaactgaattcgattactatcattcaattgaaagggaccctcacattactaaataactttataaaaaaaactctgcttttgaatgtctaaattttttgttcatagccctccattaaactccacttagctttaaatttcttcatcaaaattgttgcttttggcgctagagaaaaaaaaaatactttgcctttaccaacgtggccttgagactagcgtcttctgcatcatacaccgtcgacgtgtgtcggtcggctgtcacgacaaaagcaaaactccactgcccctgcaaaatgaacatgttgggagattatttaagcctgagccttttaggtgacaaagccaagctaatgcgcaggtgcgagcattatacaagcgcgccgcgaccctttgcctagtgctgtccgttctgtacgtgtacctgagctggtcagctccacatgcacaagtgtataggttgtacttaccctgcctaaagcttaatggaggaggtgagatcagagctggaaagaccagccatattaccggctccctcgcccaatcctcataactaatcagtttagaaattagcttaccagatcatgcttatcattccatttaattcatgcttggttacgttcgtcctataaatacgtgttcgtcttctcatctcgtcagatcagcacgaagc

SEQ ID NO: 489 - DNA, 976 bp, Setaria italica
catccataccgagtcaaggacttaaatacaggtgagcaagcttcaccataaggaacctaaccagctgagctgttgagtccgttgttgatgttggctccatctaaatacatttgcttgttattcgatcaaacattagcaacttttagctacaagattatatgccatgagattagtgtgctcctcgaaccaatgctctcctgatcatgagagatatttaaagggaccatacataacacataggttaagattgtacaaagatggatattgattgatgcataaaaggcttcattatcaaatcatttgccgtccaaaactgaattcgattactatcattcaattgaaagggacctcacattactaaataactttataaaaaaaactctgcttttgaatgtctaaattttttgttcatagccctccattaaactccacttagctttaaatttcttcatcaaaattgttgcttttggcgctagagaaaaaaaaaatactttgcctttaccaacgtggccttgagactagcgtcttctgcatcatacaccgtcgacgtgtgtcggtcggctgtcacgacaaaagcaaaactccactgcccctgcaaaatgaacatgttgggagattatttaagcctgagccttttaggtgacaaagccaagctaatgcgcaggtgcgagcattatacaagcgcgccgcgaccctttgcctagtgctgtccgttctgtacgtgtacctgagctggtcagctccacatgcacaagtgtataggttgtacttaccctgcctaaagcttaatggaggaggtgagatcagagctggaaagaccagccatattaccggctccctcgcccaatcctcataactaatcagtttagaaattagcttaccagatcatgcttatcattccatttaattcatgcttggttacgttcgtcctataaatacgtgttcgtcttctcatctcgtcagatcagcacgaagc

SEQ ID NO: 490 - DNA, 3319 bp, Setaria italica
  misc_feature (235)..(235): w= a or t.
aacgcaaatgacaaataatggttacacaaaactgcagtctaatctgtttatgaaatctatcatatacctgtagcttgaaagcaactgctagcacgagcaaacatctcgaatgacaaataatggtttctccactcatctgcaaataagaaaatcgctcaggcaaaatctcttaaaagtgcgaaaaatgtggagttgaacaaaataaatcactaccgacacattattctgaggggcwaaacgcagatccgggccacaaagcaaccggattagaagctgacaagcttggaggctgtgttgactcaacgagcttggagattggcagatccggtgaaggtggctgcagatctgtgcagggagttgtcaatgcacaagtactatcattctaaactaggattagcttctactgctcacctttttacaagcagtcaaagtcagcatgcggtggcaccagcggaaggatcgggcttgtaacgacagtttctgatgttaatcgcgtgcttcagagattgagtaaagtgctgttaattttccagaagcctaggaaaaaacacatctggaccctaccttaagcaacaacacgtcatgcttcacagaatagcagcattataatcctggtcaaacaataccacttttgcaatatgtcaaacaaaacacatggataaactgaaatgaagtcatccctttgaagccaagggtagtctcccgatagtcaacaaagtattcttcgacgaccatcacatacacacatacaactagcagcatcataatcataacagtgatctgaacggaattgttagacgatttacatttcctcgctatagatttattcaaaataaggccaaacatcttctatggatgttctaatcataactaatgtaacatcaagagaaaaaaggtaatgctttgaccaaattggtgaaatatggtaatataacacattataattatgaacctaatcaaagtgttctgggccacataaaataaattaaaagatatttgccaacgaatataatgccttcttttttaatcaatgcttgcttacaaattacaagcatatccctgtgaggggcacacaaaatctggccaccacatccggggtttggtagaagaaacatcatatcagaataacatatacattaaacagctctccgatcagttgcgtaataacatatcagaataacatcatatctagatatagtatatgtctagatgcataataatatctataaatttagaaaagctaaaacgacctacaatttggaatggagggagtagttgttttctttatttagagttcgatcggttacgtaatagtttcctttaattattcatggcagcttccactgacttactaagaaatcatagacaaattattttcagctgatgcatgacaaaaaataaataatgcttgcctacctactaaaactttggccctttcttctcagaaatgttggtaagagtaaattaccagagtagaccgggaaaggggaggaggagaacataagacagctatgaatcaggagcctagtcaaatgagcaggtaaccttgtccatgtcacttttttttttggtctcctccagggttcagcagttgcttgggatgctaaaagtttgtgacctcttttgaggcatgtaacatgctatcagtatagttgctagggatataaaattttactcctctaccatatgcaagaagccacgaacctatctgctctttgcaatgcattcatgacaaactacagatgtgcatgcatgcctctgaagtcttctgacagtaactaccctaaaaaaaatcttctgacagtaactgccctaaaaaaaagtatgctgacagtaacaaagcacgctgttgttttgttccttgaaggaaccggccactgatacgtgctgcacggaagaaccaagctttctcccgacctgtttgagtttggaagctttcaaacaaacaacatccaagctaagtccttccaggaacctgctgctgctctcgtgacaagaatgtaggccatgcgagcacctaacacacggatcatcacgcgccgtgtggctcagagttggtacaccacatcatatcgcctggattggtctgtgtacttgtgtcccctgggaaaatcagtcacttatttttagacccctggattgaacacagaataatgcaatgcaaccatgttaagcatgttgtgcacagccgtttgacaagccattccccatctttcatgtagtgatcctcacctagctaatgtaacacggcaaaactaccctaatttggcagtagaactctgatgtatggaaccatgacgaataaatggaaaatcttagacgctactcactactcatcttgaatcccagaagcttgtgtacctttcattatcatttccacaaagacagggatactgatacgtgttcaatgatgaccgaaccattaaaaaccaaagaaaccaggggcatagtctgcatatggtcgtcattaatatagtaaattaagttcaaactgtaacaacccttgtgtataacaaaagaagctggactaactatgaagcaaaaccatgcttttcgccgaggctcctctgaactttggttgcttggtttcacatagtgttaaactgttaataagcgaggttatatagttcgggtgaatatattactactgggacgaactgatatctaccactaatctactgtaaagctgcctaattttgctgtagctagatttcccggaagggggctcttgtatgctgcagaggacatattcaactgatcaatttatagacagaaagttgcatattctatcattgtgcctagcccctagctatatgatcagcataatcagcaatccatcatatcttcttctcagtgtttttttttttgctgggcgaaacaatattctttatttcagttcaatcctgtttaagcagcacttgctgtttctgcagtaacctgtaaccgtactgtacctactgctgacttgtcgcttctgagtggaaaaatgtctcacctgatcagaaacgatttcttcgcctacaattatttgggactagaagctcaatgctgtccatgcaaatttcggttaaaactgaagcatcaacagtcaaaatgtcagctaaaactgaggcatcaacagtcatacttgcagccagatggaagaacaaccgtagcagttggacacaatgtggagtcgacctagctcgctcgtttgctcaccctcttattctataagcatcaccctaacaaatccctaaccaccttcccttcgttacacacatgctagctgcctccctccagctataaatagcacccaaagcccatctcatctggccat

SEQ ID NO: 491 - DNA, 3318 bp, Setaria italica
  misc_feature (234)..(234): w= a or t.
acgcaaatgacaaataatggttacacaaaactgcagtctaatctgtttatgaaatctatcatatacctgtagcttgaaagcaactgctagcacgagcaaacatctcgaatgacaaataatggtttctccactcatctgcaaataagaaaatcgctcaggcaaaatctcttaaaagtgcgaaaaatgtggagttgaacaaaataaatcactaccgacacattattctgaggggcwaaacgcagatccgggccacaaagcaaccggattagaagctgacaagcttggaggctgtgttgactcaacgagcttggagattggcagatccggtgaaggtggctgcagatctgtgcagggagttgtcaatgcacaagtactatcattctaaactaggattagcttctactgctcacctttttacaagcagtcaaagtcagcatgcggtggcaccagcggaaggatcgggcttgtaacgacagtttctgatgttaatcgcgtgcttcagagattgagtaaagtgctgttaattttccagaagcctaggaaaaaacacatctggaccctaccttaagcaacaacacgtcatgcttcacagaatagcagcattataatcctggtcaaacaataccacttttgcaatatgtcaaacaaaacacatggataaactgaaatgaagtcatccctttgaagccaagggtagtctcccgatagtcaacaaagtattcttcgacgaccatcacatacacacatacaactagcagcatcataatcataacagtgatctgaacggaattgttagacgatttacatttcctcgctatagatttattcaaaataaggccaaacatcttctatggatgttctaatcataactaatgtaacatcaagagaaaaaaggtaatgctttgaccaaattggtgaaatatggtaatataacacattataattatgaacctaatcaaagtgttctgggccacataaaataaattaaaagatatttgccaacgaatataatgccttcttttttaatcaatgcttgcttacaaattacaagcatatccctgtgaggggcacacaaaatctggccaccacatccggggtttggtagaagaaacatcatatcagaataacatatacattaaacagctctccgatcagttgcgtaataacatatcagaataacatcatatctagatatagtatatgtctagatgcataataatatctataaatttagaaaagctaaaacgacctacaatttggaatggagggagtagttgttttctttatttagagttcgatcggttacgtaatagtttcctttaattattcatggcagcttccactgacttactaagaaatcatagacaaattattttcagctgatgcatgacaaaaaataaataatgcttgcctacctactaaaactttggccctttcttctcagaaatgttggtaagagtaaattaccagagtagaccgggaaaggggaggaggagaacataagacagctatgaatcaggagcctagtcaaatgagcaggtaaccttgtccatgtcacttttttttttggtctcctccagggttcagcagttgcttgggatgctaaaagtttgtgacctcttttgaggcatgtaacatgctatcagtatagttgctagggatataaaattttactcctctaccatatgcaagaagccacgaacctatctgctctttgcaatgcattcatgacaaactacagatgtgcatgcatgcctctgaagtcttctgacagtaactaccctaaaaaaaatcttctgacagtaactgccctaaaaaaaagtatgctgacagtaacaaagcacgctgttgttttgttccttgaaggaaccggccactgatacgtgctgcacggaagaaccaagctttctcccgacctgtttgagtttggaagctttcaaacaaacaacatccaagctaagtccttccaggaacctgctgctgctctcgtgacaagaatgtaggccatgcgagcacctaacacacggatcatcacgcgccgtgtggctcagagttggtacaccacatcatatcgcctggattggtctgtgtacttgtgtcccctgggaaaatcagtcacttatttttagacccctggattgaacacagaataatgcaatgcaaccatgttaagcatgttgtgcacagccgtttgacaagccattccccatctttcatgtagtgatcctcacctagctaatgtaacacggcaaaactaccctaatttggcagtagaactctgatgtatggaaccatgacgaataaatggaaaatcttagacgctactcactactcatcttgaatcccagaagcttgtgtacctttcattatcatttccacaaagacagggatactgatacgtgttcaatgatgaccgaaccattaaaaaccaaagaaaccaggggcatagtctgcatatggtcgtcattaatatagtaaattaagttcaaactgtaacaacccttgtgtataacaaaagaagctggactaactatgaagcaaaaccatgcttttcgccgaggctcctctgaactttggttgcttggtttcacatagtgttaaactgttaataagcgaggttatatagttcgggtgaatatattactactgggacgaactgatatctaccactaatctactgtaaagctgcctaattttgctgtagctagatttcccggaagggggctcttgtatgctgcagaggacatattcaactgatcaatttatagacagaaagttgcatattctatcattgtgcctagcccctagctatatgatcagcataatcagcaatccatcatatcttcttctcagtgtttttttttttgctgggcgaaacaatattctttatttcagttcaatcctgtttaagcagcacttgctgtttctgcagtaacctgtaaccgtactgtacctactgctgacttgtcgcttctgagtggaaaaatgtctcacctgatcagaaacgatttcttcgcctacaattatttgggactagaagctcaatgctgtccatgcaaatttcggttaaaactgaagcatcaacagtcaaaatgtcagctaaaactgaggcatcaacagtcatacttgcagccagatggaagaacaaccgtagcagttggacacaatgtggagtcgacctagctcgctcgtttgctcaccctcttattctataagcatcaccctaacaaatccctaaccaccttcccttcgttacacacatgctagctgcctccctccagctataaatagcacccaaagcccatctcatctggccat

SEQ ID NO: 492 - DNA, 1005 bp, Setaria italica
cttagacgctactcactactcatcttgaatcccagaagcttgtgtacctttcattatcatttccacaaagacagggatactgatacgtgttcaatgatgaccgaaccattaaaaaccaaagaaaccaggggcatagtctgcatatggtcgtcattaatatagtaaattaagttcaaactgtaacaacccttgtgtataacaaaagaagctggactaactatgaagcaaaaccatgcttttcgccgaggctcctctgaactttggttgcttggtttcacatagtgttaaactgttaataagcgaggttatatagttcgggtgaatatattactactgggacgaactgatatctaccactaatctactgtaaagctgcctaattttgctgtagctagatttcccggaagggggctcttgtatgctgcagaggacatattcaactgatcaatttatagacagaaagttgcatattctatcattgtgcctagcccctagctatatgatcagcataatcagcaatccatcatatcttcttctcagtgtttttttttttgctgggcgaaacaatattctttatttcagttcaatcctgtttaagcagcacttgctgtttctgcagtaacctgtaaccgtactgtacctactgctgacttgtcgcttctgagtggaaaaatgtctcacctgatcagaaacgatttcttcgcctacaattatttgggactagaagctcaatgctgtccatgcaaatttcggttaaaactgaagcatcaacagtcaaaatgtcagctaaaactgaggcatcaacagtcatacttgcagccagatggaagaacaaccgtagcagttggacacaatgtggagtcgacctagctcgctcgtttgctcaccctcttattctataagcatcaccctaacaaatccctaaccaccttcccttcgttacacacatgctagctgcctccctccagctataaatagcacccaaagcccatctcatctggccat

SEQ ID NO: 493 - DNA, 654 bp, Setaria italica; identical to SEQ ID NO: 79

SEQ ID NO: 494 - DNA, 2609 bp, Setaria italica
acatcgtattgtatttaggtgcatgcctatctgtagctcgatggaaaatgcacactttacgagaagtactacttttccacgtgggagttagccatgagcgagcaccgtgactgatgaaaacatgggcccggttgggccttttcggcctcaattagcaacaaacttagacgaccggcaagggggaaaacggcccatatacaataacagaccttaatttcttctcctctcattttggcccgtcccatgttggtcggaggacatcatgcatgattcatcgcagagatcggacgacccacgaagcccatgatagacctcctccttccctcctctccatgttcttcacaaaaaagccccttctgcacctctcgtgttcatctctggaaagaagcccccgctccctccattgcccgacttcggcggcgctaccatgcaatgcaaccatggccaacccccctgaccgttgtgagcacgacaccccatctcttgcttgtccaaccaccctccaccactactgcggcgagcggcgccgcgtctccgtccgcccaagcgggcggtggcgcctggccgcagcatcagtagcaactagggttggagtgtgaatagaggagaagaggaagaataactctgcaattttggtcattgcaaggatctcaatgcacaagatgtggaacctcctagaagatggataggattttccgttgttggtgcactgacaagttgggtcatgctcataataggaaatgttggtcacacagccaacctgcaggtcggagggttgattcacatggttgcgtatcacgggcgtgatacgaatacccccggacggccggtgtacatgcaatctcgtaattgatgtactgtaccgaccggtagttcgaacacacatgtatatgtttgacctggctgaaaaaagattttcagttgcattcatgttccattatcggtcgattatacatgtagcgcgaaatatgtgtgtacgtgatacatgcatgcaatagcatagtagcagtagcaaaaatacgaaaaacatcattctggattccaagttttggtccttcatttttcgaaaataaaaggatttgcacatgcatggtctgccgagtttgtgtatgtccgactaaaggagtgctaaagtgtggcatatataggacgatttcaccggcatgcttatgcttatgctacggtgtgtaaaccgacgcagcagctagctagatttgtttactgctgaaacgacgccctgatgacagtgacagaaacgtggcaaagctaactgtaaccgaatatatagttcggtgcatatgcctgtgctgtgtatatcctagctagctcctatttcatttctagtatcctaatgggagccaatttcaagatccgttgacctagtatgtcgagagtgtttacagggatagagttacgccattgcgtgtattttaaaggataaatgtgcatacgtatatacgggcgtttgtatctttacactatgttttcaaagaaagaaaaaaaactaatacttatccctcctgctgcggcggcaatatcatatcaaaaccccccgtatgtttcaggaaaaatggatcgaataaaacatctggagtagaactgtagaatcaaacgcgcgtctctctttcaaaaaaaaaaaaaggaaatcaaacgcgtgtgccgcgcggcgatttttttaaacaagctcaacgcctagtggatgatgagagtagagacgtgcatgcatccgcaggtcagctgcttgagctgtacgtgcgcttgctgcgaccttcgcggccgcgcaccatgttccctccccctgttttaatgggagttgatcgacatcgcgtgcgtccatggcaacatgaacgcgtgcacgccgcgcgcgatgtcatccctgccgtcgtcgttgtagacccggccacccgggcatgtatgggaaatggaactatggattcgtacatacttctcaaaaatgcaaccgtaactttacagttcgatcttacccagtgaccaataatcaccatttgcgctctctttttcttatttcttatgactaccttgtatgctgaggataacgtaagaatttgattaagaatttgattgtgtgcggagctgtttaggctggaaacaatttctttttctaaacagtactctctccgttccaaattgtagatcattttaacttttctaagttcatagatattattatacacttagagatacactgtatctagatgcataataatatctatgaattacaaaaagctaaaataacctacaatttgagcggagcggagggagtattatctgcaaacacaaagtgcactgggtgtagaacttcccaccacttcatcaaagccccccggggcgagccaatcagacggcgccacaatcagagcgcgtgtgccgcgcgcgtcgcttaattaacaacaacgcgcgcgcaacttgatcggatatgatgaagcatcgccggtcagctgcttgagctgttacgtgggcttccttccggtggacctccgcgtccatggcaacatgcgccgccgaaaaccacggagacagtgtccctgtcacacttgtacccttccgcgagctataaattgcacccctaaccatgtcgcagagcacac

SEQ ID NO: 495 - DNA, 1024 bp, Setaria italica
catctggagtagaactgtagaatcaaacgcgcgtctctctttcaaaaaaaaaaaaaggaaatcaaacgcgtgtgccgcgcggcgatttttttaaacaagctcaacgcctagtggatgatgagagtagagacgtgcatgcatccgcaggtcagctgcttgagctgtacgtgcgcttgctgcgaccttcgcggccgcgcaccatgttccctccccctgttttaatgggagttgatcgacatcgcgtgcgtccatggcaacatgaacgcgtgcacgccgcgcgcgatgtcatccctgccgtcgtcgttgtagacccggccacccgggcatgtatgggaaatggaactatggattcgtacatacttctcaaaaatgcaaccgtaactttacagttcgatcttacccagtgaccaataatcaccatttgcgctctctttttcttatttcttatgactaccttgtatgctgaggataacgtaagaatttgattaagaatttgattgtgtgcggagctgtttaggctggaaacaatttctttttctaaacagtactctctccgttccaaattgtagatcattttaacttttctaagttcatagatattattatacacttagagatacactgtatctagatgcataataatatctatgaattacaaaaagctaaaataacctacaatttgagcggagcggagggagtattatctgcaaacacaaagtgcactgggtgtagaacttcccaccacttcatcaaagccccccggggcgagccaatcagacggcgccacaatcagagcgcgtgtgccgcgcgcgtcgcttaattaacaacaacgcgcgcgcaacttgatcggatatgatgaagcatcgccggtcagctgcttgagctgttacgtgggcttccttccggtggacctccgcgtccatggcaacatgcgccgccgaaaaccacggagacagtgtccctgtcacacttgtacccttccgcgagctataaattgcacccctaaccatgtcgcagagcacac

SEQ ID NO: 496 - DNA, 658 bp, Setaria italica
atctaccactaatctactgtaaagctgcctaattttgctgtagctagatttcccggaagggggctcttgtatgctgcagaggacatattcaactgatcaatttatagacagaaagttgcatattctatcattgtgcctagcccctagctatatgatcagcataatcagcaatccatcatatcttcttctcagtgtttttttttttgctgggcgaaacaatattctttatttcagttcaatcctgtttaagcagcacttgctgtttctgcagtaacctgtaaccgtactgtacctactgctgacttgtcgcttctgagtggaaaaatgtctcacctgatcagaaacgatttcttcgcctacaattatttgggactagaagctcaatgctgtccatgcaaatttcggttaaaactgaagcatcaacagtcaaaatgtcagctaaaactgaggcatcaacagtcatacttgcagccagatggaagaacaaccgtagcagttggacacaatgtggagtcgacctagctcgctcgtttgctcaccctcttattctataagcatcaccctaacaaatccctaaccaccttcccttcgttacacacatgctagctgcctccctccagctataaatagcacccaaagcccatctcatctggccatc

SEQ ID NO: 497 - DNA, 1166 bp, Setaria italica
ccaaaatgtaggccgatggcaacatgtcagcaatactctctctagccctaaacgaaggacattcagaaaactcagacaaattattaaaattatttatttatcatatttaggctaattgacagtcgttgcaaattataatttaatagagtaacaatgacaaaaaaaattgggataaattttggatcacataataactttattttaggaacggagggaattctcctatgttccatatggttaatactttaatagattaaggtactacctcctttcttaaatacatgacaccattaatttttttcattcatttgactattcatttatatataaatatttatgctttatgctaatagataaatctctaaatcaaattcaaagtaatttaaggaaagacatagcggtactcattttattttacttaactaatttactaaatagatattgttgtcaaaatttaagaaaaaaaagttaacggcgtcataaattttgaaaaaggagagaatatgttttcagataacacgcatgcttaatttctaatctttatcctttgattggctgaaaaagatacgaacaatgaacgaaatataaaaatagccgaatacatcaccatgtagatcgagaccggaatatttggtttttcaccgtctaaaaaagacttataataaacaacggctataatatctctcatgagtcatgattgtatactagatagaccccatcgtgatatacaaattaaaaatagccgtatacatcaatggtgagaccggaacattttgttttccaccgtggaaaagaaagttgtacaagtaccccaacagccgctatatctgtcatgagtcatgactttatactagaccccaccatgataaccttgagcagcaaaatattcacaggatcaaggatcaacagcaacattatgcataccacaaatcttgtggcagagttgcactggcaccaagaaccgaatccatcccacggataagatatgccatgtggcgggcggccagtgggtggaatcgacggggggcgaccgccgcgccggctggggataatccgcgcccatgcaatttgaggccattacacctcaccctctcatcactctctctccatccgacgccgaggtcgcgacacacctgagcagggagcgcgtgccagtgccaccaccc

SEQ ID NO: 498 - DNA, 1482 bp, Setaria italica
gcgcaggggttgggccggaatgggagttgctcggctcatgagaggtttaagggtttctattgatttgagtaagatttgtaatttaaatttgaattggttttcaaaattggctgggatttgagatgtgggctgggatagggtacagaaatgggacttttaaaaggatcctcaagttaggaatatttgactgagatgagatgggaatcctatagggttttggttgctattaatactcaaatggaatttgaatattatttctaggttttgcgagaggaaggatttggaaatttctatttctaaaaggggttctaagggaaacaatcacgtgcaacacatatgctaatattttgtgcaagatttatttataaaaaggttttgaatattcgggaagaaggtatgtgtttagtctaagaaaaaatttaaaaagtacgtattttaaatgctctaaaacgtggacgttacattttatgttgtattcctgttgatgtacatctcacacgtatcaaccgcaattgtattgtacacgttacctcatcaaaaatttatgtgaggaaaccttcaagtgaaaattcataaagagaaaaagagtacaacattaaatcttcttagctatataatattctatatttgctattctttatatgaatagtaatcaatcttcaagctttatacataaacttcatgattcttgcaataaagatctgcatgatctaaataatcaagtggtatagcttcatgttaaaattcaataattaatcaagttgattccttctagatataatttaaaagactttagatctaaacatgattaaagatatgctcccctcctagcgacatcttttgaatgtgttcaaaatgtcttagtcacattcttcataaatgcataagatggaggaaccgcatctttcccgcaatcggccattgctgcgtgctgcatcaacctccatggatccttattgaaaactactctcccgtggcctcttccacgacgtgactctactctcccgtggcctcttcccgcagacgcagaggcctgcagccgtgttgaaacccggcggggaccgtaccactttggcttcgatgtcgccaattcctcgctgtcccgtgctccaggttcactagcagccgcgtgagaaaaactggcggggctcgccgcgccgagaaaaatctcgccacacagctcacgagtcacgacggacaccgagaggccgagaccgcagaggcaaggaaagccgcaagcggcgttggcgagaggcggccaagcggaagctagctgccagcgtggatcgccatcccgccccgtcgtccagaagataaggagcgccgctaggtgccgacacgtcgcgccggacgagataaggataggccagcctggccgggtgacgccaccggcgaacggtgtccactcctgccacatccggccatggagccgctggctatttatatacgccgccggtggagaggagcctctcaagcaagact

SEQ ID NO: 499 - DNA, 1833 bp, Setaria italica
tatcggcgaccgctaagagaagacatttaaaataagtagtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccac

SEQ ID NO: 500 - DNA, 2051 bp, Setaria italica
atcggcgaccgctaagagaagacatttaaaataagtagtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaaggggggctcaaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatc

SEQ ID NO: 501 - DNA, 2014 bp, Setaria italica
gtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaaggggggctcaaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatc

SEQ ID NO: 502 - DNA, 2026 bp, Setaria italica
gtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaaggggggctcaaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttag

SEQ ID NO: 503 - DNA, 2072 bp, Setaria italica
gagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttagcgatcaagttaattttgtttctgctttgtgcgcctgtgttccagtaattactttccgtgtagcaaaa

SEQ ID NO: 504 - DNA, 1108 bp, Setaria italica
tatcggcgaccgctaagagaagacatttaaaataagtagtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctct

SEQ ID NO: 505 - DNA, 1101 bp, Setaria italica
tatcggcgaccgctaagagaagacatttaaaataagtagtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcataga

SEQ ID NO: 506 - DNA, 609 bp, Setaria italica
agacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctct

SEQ ID NO: 507 - DNA, 602 bp, Setaria italica
agacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcataga

SEQ ID NO: 508 - DNA, 1032 bp, Setaria italica
tagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttagcgatcaagttaattttgtttctgctttgtgcgcctgtgttccagtaattactttccgtgtagcaaaa

SEQ ID NO: 509 - DNA, 1630 bp, Setaria italica
agacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttagcgatcaagttaattttgtttctgctttgtgcgcctgtgttccagtaattactttccgtgtagcaaaa

SEQ ID NO: 510 - DNA, 2129 bp, Setaria italica
tatcggcgaccgctaagagaagacatttaaaataagtagtcggcattgtgataaaaagagagcgcgattactgatgtgcaggttctcgattgttgatgaagtcgactagtcggagtcgattctgactagttattgattgtatggaacccgccctcgactagttttctagtcgagacgagtagtcgaagtagaccatcctcaactacttttctagttgagatgagtagtcgaagtagtcgtcggcgacttgattatttgcctcaatctgtgtgtgacttgatcgacgagccgtatgcagcagcttgcggtggaaaccgactcagtcttcgattggaacacggagcgcgtcaattctatgtcgacgtagatttgtctgcttggaactccaactcagtgacttgcttcttgttgagtagattgatcttgatgatgaggtccttcaagctcgcctgatgatctcgacgatcacctctacctgacgcgccaactgttggtgcttagacccagcaacctaccgagggggtacccgaggtagtgttttgtggtggggctcgtcgaagatcaggaacttgaaggtgaactcgaacacacgatttagacaagttcgggctgcttatgccgcataataccccatgtcatgtgtgttggttggattgtattgattgatcagatatttggagggggccctgcctcgccttatattgcccattgccggaggcagggctacaggtcggttgttgtacaagagtactagtcggttttgaccagcgagtcctactctaattgctacaagtagtttcctaatccttgactagtccttgtccgccacgtagaccacgacgtcttgcacctagtctctgtgtttgatacatcttggtgtacagtccgatattgtaggactatccaagcttcccagtaggcccatagatgtatggccgacaactggataatgtaactctgggtcagtactatccttatctatatagacacaaacaacgtactatagcagaagtttaagctcgtaacccaccaatatttggtggcatagaccacgtattgctgatatagtgctcgtaacccaccaatatttcgtggcatagagatctcttaggcaataaattagcagtacgaaacaatctatgtccacgtgttgctaatacaatgttctaaaccttacagcctactggacagttctctagccatgatacatgtgcatgtccgaacaaatatttatgggtacccgaaaggttaattttttgtagtatttatgagggggaggggggcgttgacgaaaaaaataacttagctaagcgtaattggcttaaaaacatacaatgttgttccagcatcaagcctacgtgatcatttcacaaaaccaactcaaaagataggtgtcatgttccttttagtgcaaaacttaaggacacctaccttgcaaaacttagctttgttacccagaatgaaccgctaagctcgaggagctctgaacttacatgaccaaatatattaaacacaaaagtcatgcatgattttctttaataagtatcgagcaatatggttcgggtgtctttcgtctcatacctctattgtcctccgtgatcaacaagggtggatccgggtggtgcaagggggctcaagcccccctacctctcccaaaggagaaagaagggagaagaaagtgaaggaagaagaaaccccctatattctaatgctacctccgccactgctgatcaacacaacattcttaaaaccatttccttggcatttgcgcatgttacaaggtacaaaagagccagcccatatgccaagttactaaactaaactatgatccaccatggagcgagaacaaacgtcaacaggcatcaaccaatgcagcaatcttgatcgctagtactgtccggcattatatctgaaacaaatccagatcacccatctcatcacagtcacatgcattcatggtcacgggaaccgttagcaaaccaccaactaatcagcattgcaacactcttcctcctataaatgcagcgagcgggggacaccataaaccatcacaggcacttagcgatcaagttaattttgtttctgctttgtgcgcctgtgttccagtaattactttccgtgtagcaaaa

SEQ ID NO: 511 - DNA, 1899 bp, Setaria italica; identical to SEQ ID NO: 408

SEQ ID NO: 512 - DNA, 1545 bp, Setaria italica
gcgcaggggttgggccggaatgggagttgctcggctcatgagaggtttaagggtttctattgatttgagtaagatttgtaatttaaatttgaattggttttcaaaattggctgggatttgagatgtgggctgggatagggtacagaaatgggacttttaaaaggatcctcaagttaggaatatttgactgagatgagatgggaatcctatagggttttggttgctattaatactcaaatggaatttgaatattatttctaggttttgcgagaggaaggatttggaaatttctatttctaaaaggggttctaagggaaacaatcacgtgcaacacatatgctaatattttgtgcaagatttatttataaaaaggttttgaatattcgggaagaaggtatgtgtttagtctaagaaaaaatttaaaaagtacgtattttaaatgctctaaaacgtggacgttacattttatgttgtattcctgttgatgtacatctcacacgtatcaaccgcaattgtattgtacacgttacctcatcaaaaatttatgtgaggaaaccttcaagtgaaaattcataaagagaaaaagagtacaacattaaatcttcttagctatataatattctatatttgctattctttatatgaatagtaatcaatcttcaagctttatacataaacttcatgattcttgcaataaagatctgcatgatctaaataatcaagtggtatagcttcatgttaaaattcaataattaatcaagttgattccttctagatataatttaaaagactttagatctaaacatgattaaagatatgctcccctcctagcgacatcttttgaatgtgttcaaaatgtcttagtcacattcttcataaatgcataagatggaggaaccgcatctttcccgcaatcggccattgctgcgtgctgcatcaacctccatggatccttattgaaaactactctcccgtggcctcttccacgacgtgactctactctcccgtggcctcttcccgcagacgcagaggcctgcagccgtgttgaaacccggcggggaccgtaccactttggcttcgatgtcgccaattcctcgctgtcccgtgctccaggttcactagcagccgcgtgagaaaaactggcggggctcgccgcgccgagaaaaatctcgccacacagctcacgagtcacgacggacaccgagaggccgagaccgcagaggcaaggaaagccgcaagcggcgttggcgagaggcggccaagcggaagctagctgccagcgtggatcgccatcccgccccgtcgtccagaagataaggagcgccgctaggtgccgacacgtcgcgccggacgagataaggataggccagcctggccgggtgacgccaccggcgaacggtgtccactcctgccacatccggccatggagccgctggctatttatatacgccgccggtggagaggagcctctcaagcaagactgcctcttcttctccttcgtaaatacagtactagtaagcgtatactagcactagctagtaagcc

SEQ ID NO: 513 - DNA, 2209 bp, Setaria italica
ctataacaccaggagacgtcctggttgaatggacgttgttacacgctcgccttcccactcgttgtgctgaatctcttgctgctgcgcctcgtcgaccttcgaattcggcgtgcaccgggcttgaaggaaagcgggatctccaaaaccactgtcgcgagacctgcatggggcagcaatcagatttttgggcagcgtcttcacgcgaccgcttggtgattctgcaacatccgcttcaacacgttcgactagttctgcgccggatcttgttctagataatatgttgcctgcttacttgtattatttgcttgcatcagtttttatcaatgtgtttttgcttcagataaaatctggaatattttttaggcacatatttccaacaacctacactcagctcgcaagtttaactgatatattgttcacatgcatgatattgttcgttgggagctcactcaaggtaagttgtatggctgcttttatgtttactcaaggtaagttgtatggctgcttttatgttttaagagtcaacactcggcaccaatcaagagcattttcaatctggttctttttttttttttgctaatttgtgatgatctggtttctagggtcaactgacttcttgcatccgcacagtacagtcagcttatattttaggagtatcgcgtcatgtgaatttcggcacaacgtacgacggtgcaatgtgccgttactgtcatccactcatcttttcaacgtcctcgatatacgtgttctatatgattccaaatttaacttttattggtattttgtacctggctgagtaatgcatggtcatgttcttttagctttgttaaatcggcaaagaatgatggagtattaagtactacgaacgaaaggcagcatggccgccacggccgtgcgtgtccgctagcctatggcacccgatacggcctcgctgggtgctgcggcagcgattaggaaatatggaaattaggataagtcaaaaggacgatttccccataagcaagttttttttatcagtggagaaatctatatatatacgattacaaggatgatacacatacacataggcaaatcgtactcacaaccaaaagagtgagccttctatcaaacatctataaataaattgctgaaagtacttgcacgtgcgcaagtcataggcactacgatgtgaaatcgatctagtggtaactacttcctctgatgataaatatatgtaagttcatctttttctaaatcaaacttttatctttgatcattaatatatagtaactcatgtagtagtttgaaaatatgagattaatgtcaacatatttattataatacatttcgataatatagatttttaaaattaaagtgacacaccataagcatggattttatttgtgatcggagaaggaatacaaaatttcgaagtcatcaattagacaaggcaatatacaaccgaataggtataaaatgtactggctattttttttctttttttaaaatatacagtacagacgcatatatacacatgcgctcaccctcaccctatgaatgtatgcctacacaacctacctgtatatgagcatcacgagagactaaaaaattactagtgataatataaatgcgagcacatatatatgcttgtcgtacattgaggcaccctaagatatgatgtggttccccttaataaccctatagaagagatgtcgatcttggctggaaatcttgatcgcaaatgtacatacccaacacatgcacacttgatctgtatgagtatcaattgagattgcgttgacatcacatactccaagcgtcacatggccaggctgatctccaagattattatacagtgatgcacacttgtcaaggtattattagcccgtaacacatgcaaacttgatctgtatgagtgtcaattgagattgcgttgacatcacatgctccaagcgtcccatggccaggctgatctccaagattatacagtgatgcacacttgtcaagctattattagcccgtaacacatgcacacttgatctgtatgagtgtcaattgagattgcgttgacatcacatactccaagcgtcacatggccaggctctccaagattatacagtgatgcgcacttgtccaagctattattagcccgtacgttgcgagcgggcgggtataaaacggaggctggtgagctccttatatcacaccaaagtgcacaagctaacctaag

SEQ ID NO: 514 - DNA, 1030 bp, Setaria italica
tagtggtaactacttcctctgatgataaatatatgtaagttcatctttttctaaatcaaacttttatctttgatcattaatatatagtaactcatgtagtagtttgaaaatatgagattaatgtcaacatatttattataatacatttcgataatatagatttttaaaattaaagtgacacaccataagcatggattttatttgtgatcggagaaggaatacaaaatttcgaagtcatcaattagacaaggcaatatacaaccgaataggtataaaatgtactggctattttttttctttttttaaaatatacagtacagacgcatatatacacatgcgctcaccctcaccctatgaatgtatgcctacacaacctacctgtatatgagcatcacgagagactaaaaaattactagtgataatataaatgcgagcacatatatatgcttgtcgtacattgaggcaccctaagatatgatgtggttccccttaataaccctatagaagagatgtcgatcttggctggaaatcttgatcgcaaatgtacatacccaacacatgcacacttgatctgtatgagtatcaattgagattgcgttgacatcacatactccaagcgtcacatggccaggctgatctccaagattattatacagtgatgcacacttgtcaaggtattattagcccgtaacacatgcaaacttgatctgtatgagtgtcaattgagattgcgttgacatcacatgctccaagcgtcccatggccaggctgatctccaagattatacagtgatgcacacttgtcaagctattattagcccgtaacacatgcacacttgatctgtatgagtgtcaattgagattgcgttgacatcacatactccaagcgtcacatggccaggctctccaagattatacagtgatgcgcacttgtccaagctattattagcccgtacgttgcgagcgggcgggtataaaacggaggctggtgagctccttatatcacaccaaagtgcacaagctaacctaag

SEQ ID NO: 515 - DNA, 1443 bp, Setaria italica
gttgtttggtagctgggtttagtagagatcaccaacttatctgctattatttctcttatgcatggcacagtactctaagacacaacaataccaatgaaacggaaatgttacattaagctaatattttgtcatatcttaacatcaccgtcacaattaaggggacacatcccagcagatgtcatgtttattttctgcccatggcacccaactggtttagggtgaggtattcaaattcaattttgaaatatccagcacgcttaatgcatattcatctacattatatattaatttcaatacaaaaatattctccaccagaaatttgacactctggatttctgatacatttcaattttttttttcgcagaagccgcatgagcttgcttaatgtttggcatcaggagaagagcataaacaagtctccttttccatagtgcaccgcataagtcagaacgggaaaagctttgaggtagccaaaggattcagcaaatctgccgcagacctcaggagctttccagcgagtataaatgcaccttcaattcacccaccatacttctttcaatatactcgaccctactttatccaaagggttaagcactaataagttaaataacaggcaacttgtttggaacatatattctcctgacctatagcattcccaaacagagagaaaccaggcagtgtggaaatgtctaagtttctcttcaagggaaaatactgtggtgttggtgcatgacaagtcagtgatattgacctatcaacacgaagtcacagtctcatagataatgtcaaacaaaccctgtttcctgcagccaaaatattcttgcaaggattttaatttccgaagtcaaacaaaccttggctcccaaaatattcttgcaaggattttcatttccagatagaaatgtggatgaaagtctagagcaactccccaattttatttttttattttctagaaaatggtattgtgggccatttttcccctcccacctccatctccccagtgatccttatttactgagtacttgctcgtcccagaggggaggtcagagggcagccaatgagggatgaaagttggttggaagaagtagggggacagaaatcctgacaaaggcctaccacatctcccaccccatccctcctcggccctcatttctctcttgcctctgaaaactgaaggcaggacagtctcatagggcatgctcaaaaggacacaagatcttcttggggcacagtagtatatgaaaccacaagagggattcgacttaccactgtcggagaagactaacaaggaaggaagcaaaggcctaccatatggtatttatatatgccccttctctggtcctttcttgaacatgtcacacatggacgcgtgctaacatgcatgtgtgaacctatctcagtagctcattaatctctctttgcagcttagctctgctcactctc

SEQ ID NO: 516 - DNA, 1365 bp, Setaria italica
aaaaattttgttgtttggtagctgggtttagtagagatcaccaacttatctgctattatttctcttatgcatggcacagtactctaagacacaacaataccaatgaaacggaaatgttacattaagctaatattttgtcatatcttaacatcaccgtcacaattaaggggacacatcccagcagatgtcatgtttattttctgcccatggcacccaactggtttagggtgaggtattcaaattcaattttgaaatatccagcacgcttaatgcatattcatctacattatatattaatttcaatacaaaaatattctccaccagaaatttgacactctggatttctgatacatttcaattttttttttcgcagaagccgcatgagcttgcttaatgtttggcatcaggagaagagcataaacaagtctccttttccatagtgcaccgcataagtcagaacgggaaaagctttgaggtagccaaaggattcagcaaatctgccgcagacctcaggagctttccagcgagtataaatgcaccttcaattcacccaccatacttctttcaatatactcgaccctactttatccaaagggttaagcactaataagttaaataacaggcaacttgtttggaacatatattctcctgacctatagcattcccaaacagagagaaaccaggcagtgtggaaatgtctaagtttctcttcaagggaaaatactgtggtgttggtgcatgacaagtcagtgatattgacctatcaacacgaagtcacagtctcatagataatgtcaaacaaaccctgtttcctgcagccaaaatattcttgcaaggattttaatttccgaagtcaaacaaaccttggctcccaaaatattcttgcaaggattttcatttccagatagaaatgtggatgaaagtctagagcaactccccaattttatttttttattttctagaaaatggtattgtgggccatttttcccctcccacctccatctccccagtgatccttatttactgagtacttgctcgtcccagaggggaggtcagagggcagccaatgagggatgaaagttggttggaagaagtagggggacagaaatcctgacaaaggcctaccacatctcccaccccatccctcctcggccctcatttctctcttgcctctgaaaactgaaggcaggacagtctcatagggcatgctcaaaaggacacaagatcttcttggggcacagtagtatatgaaaccacaagagggattcgacttaccactgtcggagaagactaacaaggaaggaagcaaaggcctaccatatggtatttatatatgccccttctctggtcctttcttgaacatgt

SEQ ID NO: 517 - DNA, 1356 bp, Setaria italica
gttgtttggtagctgggtttagtagagatcaccaacttatctgctattatttctcttatgcatggcacagtactctaagacacaacaataccaatgaaacggaaatgttacattaagctaatattttgtcatatcttaacatcaccgtcacaattaaggggacacatcccagcagatgtcatgtttattttctgcccatggcacccaactggtttagggtgaggtattcaaattcaattttgaaatatccagcacgcttaatgcatattcatctacattatatattaatttcaatacaaaaatattctccaccagaaatttgacactctggatttctgatacatttcaattttttttttcgcagaagccgcatgagcttgcttaatgtttggcatcaggagaagagcataaacaagtctccttttccatagtgcaccgcataagtcagaacgggaaaagctttgaggtagccaaaggattcagcaaatctgccgcagacctcaggagctttccagcgagtataaatgcaccttcaattcacccaccatacttctttcaatatactcgaccctactttatccaaagggttaagcactaataagttaaataacaggcaacttgtttggaacatatattctcctgacctatagcattcccaaacagagagaaaccaggcagtgtggaaatgtctaagtttctcttcaagggaaaatactgtggtgttggtgcatgacaagtcagtgatattgacctatcaacacgaagtcacagtctcatagataatgtcaaacaaaccctgtttcctgcagccaaaatattcttgcaaggattttaatttccgaagtcaaacaaaccttggctcccaaaatattcttgcaaggattttcatttccagatagaaatgtggatgaaagtctagagcaactccccaattttatttttttattttctagaaaatggtattgtgggccatttttcccctcccacctccatctccccagtgatccttatttactgagtacttgctcgtcccagaggggaggtcagagggcagccaatgagggatgaaagttggttggaagaagtagggggacagaaatcctgacaaaggcctaccacatctcccaccccatccctcctcggccctcatttctctcttgcctctgaaaactgaaggcaggacagtctcatagggcatgctcaaaaggacacaagatcttcttggggcacagtagtatatgaaaccacaagagggattcgacttaccactgtcggagaagactaacaaggaaggaagcaaaggcctaccatatggtatttatatatgccccttctctggtcctttcttgaacatgt

SEQ ID NO: 518 - DNA, 910 bp, Setaria italica
tgtactgtcatattgtcgtggtttttcaattgctgtacctgatgcaaacgtaatgggtttactaatcttgcacccgccggcttcaaaatgaagagtgctaatttggtccacgtcaccatcaccggttcgaactgtctagaatggcaggcaaagatgattggacaggcatgcagggaaaaagagcaccgttgacgatgtatgcgagttcccaccattgcgagcaatgattatcagccacacgacttactcttcagagctaaccactgccatgcagagaaaaagtgaatcatattgtcatgatctacaacgaagtgaaacaatcaggcatgctaaagtgctgaaactttactgatctctcatgttggacaacaaagaatacgggaatacatcagcaacgcaactcttgagctttgcttgccgaatgaccagctagaatttccaagcatttacagaaacatgactttaagtttcagaaaaacaaatacaaggccactaaataagcgtggggataacatatcctccagatgacaggcaatctgcaacttgcagccattcaaatgtacgattaacaaaatatttaagcgccacatgagataatatatcctccaattagggcctttagtattgtcattagctcataaccatggtgcatcctcacatggacgctgcataagaagttcataatagcaacagacatatgaacaaagcatggtgcgcctgcccggccggactagctagtactaccaatcatggaataagctagtaccctaaatgaaattaaaatggtttttagcgattatccacgccgtccagaatactctaatccacaagttgaggccgcccatgaagccgcgagagggcgacgccatgtgtataaaaggggcctaagctgagtggacttgctgcatca

SEQ ID NO: 519 - DNA, 127 bp, Setaria italica
tagcgattatccacgccgtccagaatactctaatccacaagttgaggccgcccatgaagccgcgagagggcgacgccatgtgtataaaaggggcctaagctgagtggacttgctgcatcagattagt

SEQ ID NO: 520 - DNA, 2130 bp, Setaria italica
atcgttgtttgtttaagcttttgacttttcacgctgagaaactgtcaggaagctcaaacaaacacagcctatacagtgattctgtaccaatcaaaccactcacaactcaccaatgtacctgtttattttccaaatcaaccattgctgtggggcttgtgggttatgacttatgagtatgagcagtattttcccccctggaatgcaagtggcagatagcttctgagatctaccatgcaccctggtaaagctcctaccattttatttgcaatagtagatgcatataattgatggacacagagttctgaaccgtgagattttctttaacttcagagttctgtcactatgttaacgtggatctggagttttgcaggaactgtgaagaaggaaccgtacctaaaactaaaagtctcacgaagaccaaatgggcaagccagacagtcagagagacagggcttcttcggccaactggacaagggatgtgccatcatgtgctgagagattaccaaatccgcaatttgcagacgtgccttctcaatcagtttgcacaaagcgataaggtaaacaaccattggagcattgttaacagcagcctagcatggcaggatgcgtcatctgaataatgcggagggcaggacagtaggacaggacacctaatccctgcaaattctagtggctctgggacactgatcatggcccaaaagtgctaaccactgcattactaaaacgtgtgggtgttgcgagttccaagttggctgttgtcatggaatggtatgaaaatgcaaaagattctcgttgttttgttgagagttagtaaattgggatgacttcggcatgacaacagcacaaaccttacatatttggtaagacttgcaacaaaaatcaaaagaatgctagtagataccaacaaaaagaaaaaacagagctagcatgaacacttctttgatcacagttgatcaaaggtgtatggccctcagacaaagctgttgatgatggtcaaacacttttgctaccgaatatcgcagttgtcctttggtacattcacaagtttgatcttatcatcaccatcagaagttcagaaagtctcgatgaaaacaaatggaaatgaatactgcttacttagctcaaattcatattccgttgttacaggatacttaaaaaaggtaccaaaggctgttcctaatcatacgctgaagtcgttgccaccaatggcagctgtactgtcatattgtcgtggtttttcaattgctgtacctgatgcaaacgtaatgggtttactaatcttgcacccgccgacttcaaaatgaagagtgctaatttggtccacgtcaccatcaccggttcgaactgtctagaatggcaggcaaagatgattggacaggcatgcagggaaaaagagcaccgatgacgatgtatgcgagttcccaccattgcgagcaatgattatcagccacacgacttactcttcagagctaaccactgccatgcagagaaaaagtgaatcatattgtcatgatctacaacgaagtgaaacaatcaggcatgctaaagtgctgaaactttactgatctctcatgttggacaacaaagaatacgggaatacatcagcaacgcaactcttgagctttgcttgctgaatgaccagctagaatttccaagcatttacagaaacatgactttaagtttcagaaaaacaaatacaaggccactaaataagcgtggggataacatatcctccagatgacaggcaatctgcaacttgcagccattcaaatgtacgattaacaaaatatttaagcgctacatgagataatatatcctccaattagggcctttagtattgtcattagctcataaccatggtgcatcctcacatggacgctgcataagaagttcataatagcaacagacatatgaacaaagcatggtgcgcctgcccggccggactagctagtactaccaatcatggaataagctagtaccctaaatgaaattaaaatggtttttagcgattatccacgccgtccagaatactctaatccacaagttgaggccgcccatgaagccgcgagagggcgacgccatgtgtataaaaggggcctaagctgagtggacttgctgcatcagattagt

SEQ ID NO: 521 - DNA, 943 bp, Setaria italica
ctgaagtcgttgccaccaatggcagctgtactgtcatattgtcgtggtttttcaattgctgtacctgatgcaaacgtaatgggtttactaatcttgcacccgccgacttcaaaatgaagagtgctaatttggtccacgtcaccatcaccggttcgaactgtctagaatggcaggcaaagatgattggacaggcatgcagggaaaaagagcaccgatgacgatgtatgcgagttcccaccattgcgagcaatgattatcagccacacgacttactcttcagagctaaccactgccatgcagagaaaaagtgaatcatattgtcatgatctacaacgaagtgaaacaatcaggcatgctaaagtgctgaaactttactgatctctcatgttggacaacaaagaatacgggaatacatcagcaacgcaactcttgagctttgcttgctgaatgaccagctagaatttccaagcatttacagaaacatgactttaagtttcagaaaaacaaatacaaggccactaaataagcgtggggataacatatcctccagatgacaggcaatctgcaacttgcagccattcaaatgtacgattaacaaaatatttaagcgctacatgagataatatatcctccaattagggcctttagtattgtcattagctcataaccatggtgcatcctcacatggacgctgcataagaagttcataatagcaacagacatatgaacaaagcatggtgcgcctgcccggccggactagctagtactaccaatcatggaataagctagtaccctaaatgaaattaaaatggtttttagcgattatccacgccgtccagaatactctaatccacaagttgaggccgcccatgaagccgcgagagggcgacgccatgtgtataaaaggggcctaagctgagtggacttgctgcatcagattagt

SEQ ID NO: 522 - DNA, 1501 bp, Setaria italica
caggacagtaggacaggacacctaatccctgcaaattctagtggctctgggacactgatcatggcccaaaagtgctaaccactgcattactaaaacgtgtgggtgttgcgagttccaagttggctgttgtcatggaatggtatgaaaatgcaaaagattctcgttgttttgttgagagttagtaaattgggatgacttcggcatgacaacagcacaaaccttacatatttggtaagacttgcaacaaaaatcaaaagaatgctagtagataccaacaaaaagaaaaaacagagctagcatgaacacttctttgatcacagttgatcaaaggtgtatggccctcagacaaagctgttgatgatggtcaaacacttttgctaccgaatatcgcagttgtcctttggtacattcacaagtttgatcttatcatcaccatcagaagttcagaaagtctcgatgaaaacaaatggaaatgaatactgcttacttagctcaaattcatattccgttgttacaggatacttaaaaaaggtaccaaaggctgttcctaatcatacgctgaagtcgttgccaccaatggcagctgtactgtcatattgtcgtggtttttcaattgctgtacctgatgcaaacgtaatgggtttactaatcttgcacccgccgacttcaaaatgaagagtgctaatttggtccacgtcaccatcaccggttcgaactgtctagaatggcaggcaaagatgattggacaggcatgcagggaaaaagagcaccgatgacgatgtatgcgagttcccaccattgcgagcaatgattatcagccacacgacttactcttcagagctaaccactgccatgcagagaaaaagtgaatcatattgtcatgatctacaacgaagtgaaacaatcaggcatgctaaagtgctgaaactttactgatctctcatgttggacaacaaagaatacgggaatacatcagcaacgcaactcttgagctttgcttgctgaatgaccagctagaatttccaagcatttacagaaacatgactttaagtttcagaaaaacaaatacaaggccactaaataagcgtggggataacatatcctccagatgacaggcaatctgcaacttgcagccattcaaatgtacgattaacaaaatatttaagcgctacatgagataatatatcctccaattagggcctttagtattgtcattagctcataaccatggtgcatcctcacatggacgctgcataagaagttcataatagcaacagacatatgaacaaagcatggtgcgcctgcccggccggactagctagtactaccaatcatggaataagctagtaccctaaatgaaattaaaatggtttttagcgattatccacgccgtccagaatactctaatccacaagttgaggccgcccatgaagccgcgagagggcgacgccatgtgtataaaaggggcctaagctgagtggacttgctgcatcagattagt

SEQ ID NO: 523 - DNA, 723 bp, Setaria italica
ttcaatttcactggagatcgttccaccagagaaatcaccgtcggagtcattttaggatgaaaggcccaaaagcctaaatggcaggcctaccccagaggcccaagcgatcaagggtagctccgtactttcccgcgacggtgcgatacacggttcgaaatttcaaaattcgaacgggcggccaaacagccgttccttccatttccctgccgtcctcacaaaggctccccttccatccaccgaagtgaaaactaccccgactcaatgactcatgggctgggcagttcactttcatattccagtcccacatgtcagtgtcacgtcttcacgggcgcatgtgaagatcgccgagaacgagaggcgccggctccgcgggacccgccgccagctcaaacccaccgttgccggccgctgatcacgcaagcctcgccccgacgttcgaaaccaaacggccgttaacctccgctgcccccgcgcggcttcggccccgttcaccaacgaggcgggccaccaccacgccgtctaacgcgagccaaacggcggttaggtcacggcctcaccctcacgggccggccgcggccgcctcccctctcctctcgcgctgcctataaaagccgccgcggccgcctcccctctcctcacctcggcgtcttcacaaacgccagcgctccccttccactcccgatcgatcgccgctccgctccctcttccctcgcctccgcctcc

SEQ ID NO: 524 - DNA, 1067 bp, Setaria italica
aaacgtctccaattgtttgagctactactagctctgaccaggactaaagttagcttctccattggttagagacacgctctataactatctcttattgctattagtgcttgcatatgtatgagaacatggtgatagttgacatgcatggccccttttcagacaatagtggaaggggaacttgaggaccgacgatgagaattggttgatttcactaaaaattggtcacttattcttctttcttcctatttcgagatggaaaaaatattccactaaccactgactccagtgagagagatcactggaagccaggacatactcctagacaaaaagtttgcagaaaatatggcccaacgagcaaagagcggcccgtagatccactgcgtcggcccatcggcccaaccgaaccggccacatgcgggcagacgagacgaacactcgcagaagggagatccgcagaagatccgagcaacagcccagcgcaacggcagccgatactgttctcccgcttccccatttcaaaattcgaaaatatcaggcgacaacagacgaggcggaaccacccggccaaatcggccgccgcgccgcgcgtcccacctcactcacctaaaattgggtcccacctcacgtatggcccattggcaagtgagacgtcgcctctgatgcggttttccgccccgcacccaacgtgaggtgaacgggccaccaaccggttttcctagagctacacaacttggcctcacccaaccgtgtacacgctcaaaccgtacaaaaaagtttctcgggcccggttgacagacgatagccgcggtgggttgccggctaaacacaggtaccaacaaaaagcaagctaatttcctaacattttccttctagatcctctagcttatccttttttcctaccaggacaagacagcttgaaccagatcacccggtctggcacacaccacgcccacggcccacccgaccgttgcgaccgggaggagcccgaaccgtgcaaacaactaaactccagtggcttggatgaaaagggcgcccgtccctccctcccttcacctgcactccatcga

SEQ ID NO: 525 - DNA, 1060 bp, Setaria italica
tccaattgtttgagctactactagctctgaccaggactaaagttagcttctccattggttagagacacgctctataactatctcttattgctattagtgcttgcatatgtatgagaacatggtgatagttgacatgcatggccccttttcagacaatagtggaaggggaacttgaggaccgacgatgagaattggttgatttcactaaaaattggtcacttattcttctttcttcctatttcgagatggaaaaaatattccactaaccactgactccagtgagagagatcactggaagccaggacatactcctagacaaaaagtttgcagaaaatatggcccaacgagcaaagagcggcccgtagatccactgcgtcggcccatcggcccaaccgaaccggccacatgcgggcagacgagacgaacactcgcagaagggagatccgcagaagatccgagcaacagcccagcgcaacggcagccgatactgttctcccgcttccccatttcaaaattcgaaaatatcaggcgacaacagacgaggcggaaccacccggccaaatcggccgccgcgccgcgcgtcccacctcactcacctaaaattgggtcccacctcacgtatggcccattggcaagtgagacgtcgcctctgatgcggttttccgccccgcacccaacgtgaggtgaacgggccaccaaccggttttcctagagctacacaacttggcctcacccaaccgtgtacacgctcaaaccgtacaaaaaagtttctcgggcccggttgacagacgatagccgcggtgggttgccggctaaacacaggtaccaacaaaaagcaagctaatttcctaacattttccttctagatcctctagcttatccttttttcctaccaggacaagacagcttgaaccagatcacccggtctggcacacaccacgcccacggcccacccgaccgttgcgaccgggaggagcccgaaccgtgcaaacaactaaactccagtggcttggatgaaaagggcgcccgtccctccctcccttcacctgcactccatcga

SEQ ID NO: 526 - DNA, 1593 bp, Setaria italica
  misc_feature (515)..(515): r= g or a.
tagcgtagcaggctagcagcctgaactctcgggtgattctgtggcgagttagcttgctcgctgcctgcaatggagtgaatattggcagtacgaagtcacacgggcaggcagagatttggaacatggtggaaacaagaaccatcggcatcgttcttctgatcaatatagtgattactggaagaatcaagaacagaataaaaccaaggcatcctggatctaccatgtcaatctttgctttcatcctcgtcgtttggagcgagcctgttcttgtttgaggcgcgctcgaccgtgccacgaagtaacaggtgcatgaggtctgcagtctgcactagaacttcccagctcccaaattcaacgaaactgaaaaaagtcattggtaacatcaaagtcttgtcttaggatagctgctgttcttgacgctggttagatttgtccaataaattacatgaccagcgcacatgtacttggtattcgacttgatgatttgtatgtactgacggacttgaataaagtarggggaattaggactcagaagtctacgatttttggtccaatatttgattgtgatgttcaaagtcgacgtctctttcgagacgaaattgtgatgcgtagaacaaaaacgacgcaatttcttttcaaaagaaaaagattaggggcagaacaattcaggatctgtttggctggacttataagccggctgaaaagctgaaacggttgatttattgtgagagaaaaacactgtttggtggctgataagctgaaacgaacaggctgtcagtcattaggctgccggctctggaacagtgcgccatcaagagatcacccgaaccatgttgagctcatcaacgtgcgccgctgttgtgctcattggtgtcgcggtcgtggctggcgcgcatctttcgttgcgtcttgtcatggattatccacgacggcagtgtcctgttgtttatgatgacggcacttgattcgccatggatggtgaaaacgaaatcgaagtgcggtcattttttattttaccagatgacgtggttggtgacctgagaggaacagacatgagaagatgagatcagcagctcaattcccacattgacagacgacctttggagcagtacaagagacccaaatgaagaatagtgcaaattacagagtatattagaacacgagaattattaagttttactcgaggtcaatgaaagaatttaggactattcagagcacaggctgtgttcaagtcctgcatgaaccagagaaagttcccaccaaggcctccatcagaggaacgaatttgcctggaactccatcactcaccagtcaccactcaccacttaccagcctaataaagcgtagcagacaatttggagtagacgatcatcatgtgcagtctcataggccctcttctaggaataaccgtatttgatagccaatccacctatgtggtgatttttttttcctttgtccatcggggtcgctttccatccgacgtgtctgcagtgtagcgcaatccatctgtcgctttctgctttctgatgaacgttccggttgacgccgctaagctgccttgtcctccttttctcccgtctgcacagggagggg

SEQ ID NO: 527 - DNA, 856 bp, Setaria italica
actgtttggtggctgataagctgaaacgaacaggctgtcagtcattaggctgccggctctggaacagtgcgccatcaagagatcacccgaaccatgttgagctcatcaacgtgcgccgctgttgtgctcattggtgtcgcggtcgtggctggcgcgcatctttcgttgcgtcttgtcatggattatccacgacggcagtgtcctgttgtttatgatgacggcacttgattcgccatggatggtgaaaacgaaatcgaagtgcggtcattttttattttaccagatgacgtggttggtgacctgagaggaacagacatgagaagatgagatcagcagctcaattcccatattgacagacgacctttggagcagtacaagagacccaaatgaagaatagtgcaaattacagagtatattagaacacgagaattattaagttttactcgaggtcaatgaaagaatttaggactattcagagcacaggctgtgttcaagtcctgcatgaaccagagaaagttcccaccaaggcctccatcagaggaacgaatttgcctggaactccatcactcaccagtcaccactcaccacttaccagcctaataaagcgtagcagacaatttggagtagacgatcatcatgtgcagtctcataggccctcttctaggaataaccgtatttgatagccaatccacctatgtggtgatttttttttcctttgtccatcggggtcgctttccatccgacgtgtctgcagtgtagcgcaatccatctgtcgctttctgctttctgatgaacgttccggttgacgccgctaagctgccttgtcctccttttctcccgtctgcacagggagggg

SEQ ID NO: 528 - DNA, 1011 bp, Setaria italica
atcgtgcttaggaagaataccggacggctggcagtaacaaatcatacagtatttgccttctataaaggcagctggagactgttctccgaaataaatcatagcaacttaggagtgtttgatacgaggcgctaaacttcagcaggtcatatcggatgttcggatactaattataaaagtcaacacgagctaattacaaaactaattgcacagatggagtctaattcgcaagacgaatctattaaggggctgtttggatacgaggtgctaaactttaacagtgtcacgtcggatgttcggatgctaattaggaggactaaacatgagctaattgtaaaactaattgcagaaccctgtgctaattcgctagacgaatctattaagcctaattaatccatcattagcaaatggttactgtagcaccatattgtcaaatcagggactaattaggtttagtagattcgtctcgcgaattatactccatctgtgcaattacttttttaattagtctatgtttaatactcctaattagtatccaaacatccgatgtgacaggtgttaaactttaacagggcgttcccaaacacccccctaaagctaattaatccatcgttaacaaatagttattgtagcacaacattgtcaaatcatggactaattaggcttaatagattcatctcgcgaattagactccatctgtacaattaattttataattagactatatttaatacctccaattagtatcaaatattcgatgtgacatgtgctaaagtttagtagggtatccaaacaccccttctctcctttcctcttggtatgtttagcagttacccctggctcttggcatccgtttcgtcgacgtgccatggtttaacggacgggacggggacggccggctcacgtgaacaacgcccacgaggccgcgctggctcttgtaaaagcaaccgctccctccctagacgctagtgcctctttcctctctcctccgcccctttttatcgcccgatctca

SEQ ID NO: 529 - DNA, 1047 bp, Setaria italica
actatagggcacgcgtggtcgacggcccgggctggtatcgtgcttaggaagaataccggacggctggcagtaacaaatcatacagtatttgccttctataaaggcagctggagactgttctccgaaataaatcatagcaacttaggagtgtttgatacgaggcgctaaacttcagcaggtcatatcggatgttcggatactaattataaaagtcaacacgagctaattacaaaactaattgcacagatggagtctaattcgcaagacgaatctattaaggggctgtttggatacgaggtgctaaactttaacagtgtcacgtcggatgttcggatgctaattaggaggactaaacatgagctaattgtaaaactaattgcagaaccctgtgctaattcgctagacgaatctattaagcctaattaatccatcattagcaaatggttactgtagcaccatattgtcaaatcagggactaattaggtttagtagattcgtctcgcgaattatactccatctgtgcaattacttttttaattagtctatgtttaatactcctaattagtatccaaacatccgatgtgacaggtgttaaactttaacagggcgttcccaaacacccccctaaagctaattaatccatcgttaacaaatagttattgtagcacaacattgtcaaatcatggactaattaggcttaatagattcatctcgcgaattagactccatctgtacaattaattttataattagactatatttaatacctccaattagtatcaaatattcgatgtgacatgtgctaaagtttagtagggtatccaaacaccccttctctcctttcctcttggtatgtttagcagttacccctggctcttggcatccgtttcgtcgacgtgccatggtttaacggacgggacggggacggccggctcacgtgaacaacgcccacgaggccgcgctggctcttgtaaaagcaaccgctccctccctagacgctagtgcctctttcctctctcctccgcccctttttatcgcccgatctca

SEQ ID NO: 530 - DNA, 269 bp, Setaria italica
aacctccgctgcccccgcgcggcttcggccccgttcaccaacgaggcgggccaccaccacgccgtctaacgcgagccaaacggcggttaggtcacggcctcaccctcacgggccggccgcggccgcctcccctctcctctcgcgctgcctataaaagccgccgcggccgcctcccctctcctcacctcggcgtcttcacaaacgccagcgctccccttccactcccgatcgatcgccgctccgctccctcttccctcgcctccgcctcc

SEQ ID NO: 531 - DNA, 723 bp, Setaria italica; identical to SEQ ID NO: 523

SEQ ID NO: 532 - DNA, 1034 bp, Setaria italica
gccgtttttgaagtatccaggattagaagcttctactgcgcttttatattatagctgtggacctgtggtaacctttctcttttggcgcttgcttaatctcggccgtgctggtccatgcttaggcactaggcagagatagagccgggggtgaatggggctaaagctcagctgctcgaggggccgtgggctggtttccactagcctacagctgtgccacgtgcggccgcgcaagccgaagcaagcacgctgagccgttggacagcttgtcataatgccattacgtggattacacgtaactggccctgtaactactcgttcggccatcatcaaacgacgacgtccgctaggcgacgacacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggaatggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcc

SEQ ID NO: 533 - DNA, 850 bp, Setaria italica
  misc_feature (558)..(558): n= g, c, a or t.
  unsure (1)..(850): unsure at all n locations
cgggcgggtctgtgcccgtgcggccgcgcaagccgaagcaagcacgctgagccgttggacagcttgtcataatgccattacgtggattacacgtaactggccctgtaactactcgttcggccatcatcaaacgacgacgtccgctaggcgacgacacgggtaatgcacgcagccacccaggcgcgcgcgctagcggagcacggtcaggtgacacgggcgtcgtgacgcttccgagttgaaggggttaacgccagaaacagtgtttggccagggtatgaacataacaaaaaatattcacacgaaagaatggaagtatggagctgctactgtgtaaatgccaagcaggaaactcacgcccgctaacatccaacggccaacagctcgacgtgccggtcagcagagcatcggaacactggtgattggtggagccggcagtatgcgccccagcacggccgaggtggtggtggcccgtggccctgctgtctgcgcggctcgggacaacttgaaactgggccaccgcctcgtcgcaactcgcaacccgttggcggaagaaaggantggctcgtaggggcccgggtagaatcgaagaatgttgcgctgggcttcgattcacataacatgggcctgaagctctaaaacgacggcccggtcgccgcgcgatggaaagagaccggatcctcctcgtgaattctggaaggccacacgagagcgacccaccaccgacgcggaggagtcgtgcgtggtccaacacggccggcgggctgggctgcgaccttaaccagcaaggcacgccacgacccgccccgccctcgaggcataaataccctcccatcccgatgccgcaagactc

SEQ ID NO: 534 - DNA, 2215 bp, Setaria italica
gttccatatatagagattggagtaaaaaataaaaaatagcatatttctatatgttatagtctattgttggtggatgtgaaaacaaaacatcttgcacaaggtgtccaggagccccaccgtcatgggtcaacgcggagagctggtatgaagcaacggtacaaaaacagtgctattggctaggagatgaatacagtttagggtagctgctgggtaagggactaaagggtatgggttactttactgaacctcaagtgcttgtcagcacctcggctcgtcgttgcaatgcaagctgtgcctgtgaccgggtcgcctgaaaggcaaggcaaaccacatgctatgatggctgctgcgccgagaaaggaggtagctggttgggaatttgataactgagtcagttaagtgtaatgggtaacttctctctttttctgatgaaatctcctcattatgatctcatcaagtcagcaattttgctgatgtggtaataaattaatacgcatgaaactcctatgaaactaaagttataaccactctcacatgcacataaataaacacacatattggatccatagccacactgtaggttatttacaagcattggagtaacaatgtgcatcgatctagagcacagttttctcattgcatcgatcactcgatcatcacccgtggcatttcctaatagtggctactccaatatactattatgtataacaactactaccgtgtgattgaggtgaggaatcttgctgccccacacaaaagccaatccctaccgtctcttggctggagttgacggtacacggaagccaatgccaataatgccaatgcagcgccactcccacgcatcatcagaactacaacgcgctagttatgtttgcgccaatgatttcattggcgtacgtgcttattatcctgtggttagggcctatttagttgcctgattttggacaaccaaaatcactatgccagcactgtagcatattgtagcgtttcgtttatatttgtgaattattgtccaaatattgactaattaggctcaaaagattcgtcttgcaaaatacaacaaaactgtgcaattagtttttgatttcgtctacattcagtactccatgcatgtactgtaagtttgatgtgatggggaatcttcttttttacatagtgtcaaagttaggattttagggtaactaaacaatgccttagttgatgacaaactggcttcagaattactacacattggatccattactaagatgcatgttatccagatgtatataaatatcatttcaaccaataaaagttgagatgcagacatgcatatatagtggtctctagaagaagaatatatgtatatgtatgacagtagaaggtgtcaatgtatacagacatgtcaatagaacctgatgaccaaggtgtgatgagttccctttcgattgattagtatttgcagagatgggatgatgcttccattcaatgtaaacgcctaatgaatataaacggcaatctaaagcaacttctatatatcctacaagtgtttagaatagttaacaataagctactagctagctcgtggaagccatgaacacaggttagcttgctgccggacttttgggtctccccaattagcctccacactaacgtggagacctgtaaacaaacattagtttatgcgcagccaaccgacgatcgatgatggattggaaaagaataatgtgaatgtgtatgtaaactaagtaagatggtgtgtatgcaggccacaatcattgttaatcactgttgctttggttcggtttggttcacatgacgattaagcaaatgcacatggccatccgtgaataatctccgttgtatgctgcaaggaagagatagagcagtaaggacattgccattttatctgcaatacgcaggtaccgggtcgacggcaagaacagggtagttgagtgagtccctccctcccaacagctaccttggcttggggttgctgcgactgcgagcgcggtcaaaagaattgccgcgtcccccgtctgtccggccaccaaccccggccgtcaaccatgcctgcatgatctgtcagtcactacagtactattattccagcaggcgtaggctctgacgacacgaccgccaccttccatgcatcccggcgacttctctgctccactccattccatccatccatccatctatataagctagccaggccacccggtgtgcaggagcc

SEQ ID NO: 535 - DNA, 1030 bp, Setaria italica
acaatgccttagttgatgacaaactggcttcagaattactacacattggatccattactaagatgcatgttatccagatgtatataaatatcatttcaaccaataaaagttgagatgcagacatgcatatatagtggtctctagaagaagaatatatgtatatgtatgacagtagaaggtgtcaatgtatacagacatgtcaatagaacctgatgaccaaggtgtgatgagttccctttcgattgattagtatttgcagagatgggatgatgcttccattcaatgtaaacgcctaatgaatataaacggcaatctaaagcaacttctatatatcctacaagtgtttagaatagttaacaataagctactagctagctcgtggaagccatgaacacaggttagcttgctgccggacttttgggtctccccaattagcctccacactaacgtggagacctgtaaacaaacattagtttatgcgcagccaaccgacgatcgatgatggattggaaaagaataatgtgaatgtgtatgtaaactaagtaagatggtgtgtatgcaggccacaatcattgttaatcactgttgctttggttcggtttggttcacatgacgattaagcaaatgcacatggccatccgtgaataatctccgttgtatgctgcaaggaagagatagagcagtaaggacattgccattttatctgcaatacgcaggtaccgggtcgacggcaagaacagggtagttgagtgagtccctccctcccaacagctaccttggcttggggttgctgcgactgcgagcgcggtcaaaagaattgccgcgtcccccgtctgtccggccaccaaccccggccgtcaaccatgcctgcatgatctgtcagtcactacagtactattattccagcaggcgtaggctctgacgacacgaccgccaccttccatgcatcccggcgacttctctgctccactccattccatccatccatccatctatataagctagccaggccacccggtgtgcaggagcc

SEQ ID NO: 536 - DNA, 2258 bp, Setaria italica
ttgaagcatatagaatgtacaaaatgataatccagtaaacattgttccatatatagagattggagtaaaaaataaaaaatagcatatttctatatgttatagtctattgttggtggatgtgaaaacaaaacatcttgcacaaggtgtccaggagccccaccgtcatgggtcaacgcggagagctggtatgaagcaacggtacaaaaacagtgctattggctaggagatgaatacagtttagggtagctgctgggtaagggactaaagggtatgggttactttactgaacctcaagtgcttgtcagcacctcggctcgtcgttgcaatgcaagctgtgcctgtgaccgggtcgcctgaaaggcaaggcaaaccacatgctatgatggctgctgcgccgagaaaggaggtagctggttgggaatttgataactgagtcagttaagtgtaatgggtaacttctctctttttctgatgaaatctcctcattatgatctcatcaagtcagcaattttgctgatgtggtaataaattaatacgcatgaaactcctatgaaactaaagttataaccactctcacatgcacataaataaacacacatattggatccatagccacactgtaggttatttacaagcattggagtaacaatgtgcatcgatctagagcacagttttctcattgcatcgatcactcgatcatcacccgtggcatttcctaatagtggctactccaatatactattatgtataacaactactaccgtgtgattgaggtgaggaatcttgctgccccacacaaaagccaatccctaccgtctcttggctggagttgacggtacacggaagccaatgccaataatgccaatgcagcgccactcccacgcatcatcagaactacaacgcgctagttatgtttgcgccaatgatttcattggcgtacgtgcttattatcctgtggttagggcctatttagttgcctgattttggacaaccaaaatcactatgccagcactgtagcatattgtagcgtttcgtttatatttgtgaattattgtccaaatattgactaattaggctcaaaagattcgtcttgcaaaatacaacaaaactgtgcaattagtttttgatttcgtctacattcagtactccatgcatgtactgtaagtttgatgtgatggggaatcttcttttttacatagtgtcaaagttaggattttagggtaactaaacaatgccttagttgatgacaaactggcttcagaattactacacattggatccattactaagatgcatgttatccagatgtatataaatatcatttcaaccaataaaagttgagatgcagacatgcatatatagtggtctctagaagaagaatatatgtatatgtatgacagtagaaggtgtcaatgtatacagacatgtcaatagaacctgatgaccaaggtgtgatgagttccctttcgattgattagtatttgcagagatgggatgatgcttccattcaatgtaaacgcctaatgaatataaacggcaatctaaagcaacttctatatatcctacaagtgtttagaatagttaacaataagctactagctagctcgtggaagccatgaacacaggttagcttgctgccggacttttgggtctccccaattagcctccacactaacgtggagacctgtaaacaaacattagtttatgcgcagccaaccgacgatcgatgatggattggaaaagaataatgtgaatgtgtatgtaaactaagtaagatggtgtgtatgcaggccacaatcattgttaatcactgttgctttggttcggtttggttcacatgacgattaagcaaatgcacatggccatccgtgaataatctccgttgtatgctgcaaggaagagatagagcagtaaggacattgccattttatctgcaatacgcaggtaccgggtcgacggcaagaacagggtagttgagtgagtccctccctcccaacagctaccttggcttggggttgctgcgactgcgagcgcggtcaaaagaattgccgcgtcccccgtctgtccggccaccaaccccggccgtcaaccatgcctgcatgatctgtcagtcactacagtactattattccagcaggcgtaggctctgacgacacgaccgccaccttccatgcatcccggcgacttctctgctccactccattccatccatccatccatctatataagctagccaggccacccggtgtgcaggagcc

SEQ ID NO: 537 - DNA, 49 bp, Setaria italica
tgtatttccttgaccgttcagattgggagtggtcgtttccacgatagat

SEQ ID NO: 538 - DNA, 109 bp, Setaria italica
acggagcgcgccgccatccagatccagccgccggaactccgccccctccgccgtcggccccgtccgctccgaccggtcggcttctcccttgctgaacaactgaccagaa

SEQ ID NO: 539 - DNA, 110 bp, Setaria italica
gcttcgccctctcctctcctctcctctcctccccactcttcccccccgccgcgagctcgccgcccgctccccacctcctcgccgcggatcctccactactccggtagaaa

SEQ ID NO: 540 - DNA, 109 bp, Setaria italica; identical to SEQ ID NO: 538

SEQ ID NO: 541 - DNA, 110 bp, Setaria italica; identical to SEQ ID NO: 539

SEQ ID NO: 542 - DNA, 77 bp, Setaria italica; identical to SEQ ID NO: 109

SEQ ID NO: 543 - DNA, 34 bp, Setaria italica
cgtctccccgtcacctcaggatcagcaagcggca

SEQ ID NO: 544 - DNA, 201 bp, Setaria italica
cgaaggttaggaataatggtgccgagagcaatcaggcaacacacaccaaccctgctaaactcccgggcctcccagctcataaatagagtatcgctgcgaggccgagcagtgggcgaccctgtgagcttagctagcaagcaatcaagcactgccacctgaacctcacggagaaagttaaggcggcgagagacagagagatcc

SEQ ID NO: 545 - DNA, 201 bp, Setaria italica
cgaaggttaggaataatagtgccgagagcaatcaggcaacacacaccaaccctgctaaactcccgggcctcccagctcataaatagagtatcgctgcgaggccgagcagtgggcgaccctgtgagcttagctagcaagcaatcaagcactgccacctgaacctcacggagaaagttaaggcggcgagagacagagagatcc

SEQ ID NO: 546 - DNA, 158 bp, Setaria italica
cgaaggttaggaataatggtgccgagagcaatcaggcaacacacaccaaccctgctaaactcccgggcctcccagctcataaatagagtatcgctgcgaggccgagcagtgggcgaccctgtgagcttagctagcaagcaatcaagcactgccacctg

SEQ ID NO: 547 - DNA, 12 bp, Setaria italica
cacccatcagca

SEQ ID NO: 548 - DNA, 56 bp, Setaria italica
accaccaccacctgacgctctcagcacacccaggaggaggaggaggagcagcagcc

SEQ ID NO: 549 - DNA, 37 bp, Setaria italica
cctgacgctctcagcacacccaggaggaggaggagga

SEQ ID NO: 550 - DNA, 46 bp, Setaria italica
acaggaacgggattcttccttcttctggccattagctccaagatct

SEQ ID NO: 551 - DNA, 40 bp, Setaria italica
acaggaacgggattcttccttcttctggccattagctcca

SEQ ID NO: 552 - DNA, 72 bp, Setaria italica
ggtctacacgcacccacccaatccatcgtcccagctgcaaagcgcgcaagaacactccaaagcagctgagct

SEQ ID NO: 553 - DNA, 72 bp, Setaria italica; identical to SEQ ID NO: 115

SEQ ID NO: 554 - DNA, 70 bp, Setaria italica; identical to SEQ ID NO: 132

SEQ ID NO: 555 - DNA, 10 bp, Setaria italica
ccaccgccgg

SEQ ID NO: 556 - DNA, 76 bp, Setaria italica
ccaccgccggctcagtttcgtctggctgccttagcatcggcgccatccggcagcagctagcttagcgcgcgacgac

SEQ ID NO: 557 - DNA, 34 bp, Setaria italica
ctctcctaaactgccccgcacatccctgccagca

SEQ ID NO: 558 - DNA, 33 bp, Setaria italica
ctctcctaaactgccccgcacatccctgccagc

SEQ ID NO: 559 - DNA, 36 bp, Setaria italica
gcgagtttctgaggttctgtcgtgtagtaacacagg

SEQ ID NO: 560 - DNA, 72 bp, Setaria italica
cactgagcgagtacttggcaggccgatcagctcgttgatagcaagctcactcgtcagtaagtagcaatcagg

SEQ ID NO: 561 - DNA, 32 bp, Setaria italica
gcgcacaaaacaacagataggattgaacaaca

SEQ ID NO: 562 - DNA, 67 bp, Setaria italica
gctcaagcaatctcaaagaacttgtcttctccatccacaccgagtttttcggcttcttgacttgaag

SEQ ID NO: 563 - DNA, 66 bp, Setaria italica
gctcaagcaatctcaaagaacttgtcttctccatccacaccgagtttttcggcttcttgacttgaa

SEQ ID NO: 564 - DNA, 63 bp, Setaria italica
aatctcaaagaacttgtcttctccatccacaccgagtttttcggcttcttgacttgaagatct

SEQ ID NO: 565 - DNA, 58 bp, Setaria italica
aatctcaaagaacttgtcttctccatccacaccgagtttttcggcttcttgacttgaa

SEQ ID NO: 566 - DNA, 101 bp, Setaria italica
cgcattcccctctctctacgcagctcggctccactccgctccgaagagggaggaggacgcccgctgccacgctacccgctcccccggaactcgccgccacc

SEQ ID NO: 567 - DNA, 38 bp, Setaria italica
cgcattcccctctctctacgcagctcggctccactccg

SEQ ID NO: 568 - DNA, 103 bp, Setaria italica
cgcaccaataccaagcctctcccgggccagcttctagcattggctcatcaccagcactccagcaggcaggcaaaacgcaagcaacacctctccgccagacatc

SEQ ID NO: 569 - DNA, 67 bp, Setaria italica
cgcaccaataccaagcctctcccgggccagcttctagcattggctcatcaccagcactccagcaggc

SEQ ID NO: 570 - DNA, 104 bp, Setaria italica
acgcaccaataccaagcctctcccgggccagcttctagcattggctcatcaccagcactccagcaggcaggcaaaacgcaagcaacacctctccgccagacatc

SEQ ID NO: 571 - DNA, 208 bp, Setaria italica
gggccgcgagcaaagtcaactgctcgacacctcctcggccaacgtgcctatatattctcggctagccgcgtccgtactcatccaacccaactccaaacacctcatcagattcctcgcctccgtctccgaccacccaccagtcaggtaactagctagagaggaagagatcaccggccggcgatcgattattaacgcgtcaggagaagcg

SEQ ID NO: 572 - DNA, 32 bp, Setaria italica; identical to SEQ ID NO: 561

SEQ ID NO: 573 - DNA, 74 bp, Setaria italica
ctagcaagtcagcagcagcaagcaaacacacagcgttcgtgagctcttccgagcttgcattggtgtaagcaagg

SEQ ID NO: 574 - DNA, 61 bp, Setaria italica; identical to SEQ ID NO: 153

SEQ ID NO: 575 - DNA, 59 bp, Setaria italica
cgccacagccatctagctccactccagtcatctagcttcgcttcgcttcccaccacgcc

SEQ ID NO: 576 - DNA, 57 bp, Setaria italica
ccgccacagccatctagctccactccagtcatctagcttcgcttcgcttcccaccac

SEQ ID NO: 577 - DNA, 63 bp, Setaria italica
ccaccgccacagccatctagctccactccagtcatctagcttcgcttcgcttcccaccacgcc

SEQ ID NO: 578 - DNA, 73 bp, Setaria italica
cgcgcgctcccgccgcacacaccagaccctccttcctcatcagaggcaaacacaagcgcgtgcgaggggaagg

SEQ ID NO: 579 - DNA, 41 bp, Setaria italica
cgctcccgccgcacacaccagaccctccttcctcatcagag

SEQ ID NO: 580 - DNA, 57 bp, Setaria italica
tcaccaaattcatctcactaacacctccatttttattgtgatagtacccgaatacca

SEQ ID NO: 581 - DNA, 82 bp, Setaria italica
aagcaagttacccagcttgcttgcgagtgtgagcagctagctagctagcagagtgatcgagcgttggtgagctgagctggga

SEQ ID NO: 582 - DNA, 61 bp, Setaria italica; identical to SEQ ID NO: 153

SEQ ID NO: 583 - DNA, 79 bp, Setaria italica
acaggcacttagcgatcaagttaattttgtttctgctttgtgcgcctgtgttccagtaattactttccgtgtagcaaaa

SEQ ID NO: 584 - DNA, 87 bp, Setaria italica
cacacatggacgcgtgctaacatgcatgtgtgaacctatctcagtagctcattaatctctctttgcagcttagctctgctcactctc

SEQ ID NO: 585 - DNA, 75 bp, Setaria italica
gattagtaagcaatctcaagcgcagagagccaaagctttcggtgtagctcgaagagcaaagcgaaggcaagatct

SEQ ID NO: 586 - DNA, 63 bp, Setaria italica
aagcaatctcaagcgcagagagccaaagctttcggtgtagctcgaagagcaaagcgaaggcaa

SEQ ID NO: 587 - DNA, 176 bp, Setaria italica
ggcccaggctgtcgcctcgatctatataagcgagtgggaggagacgcgaaccctaagccgagcaccgcagaggaaggcgtcttcgtactcgcctctctcgcgactcaaagctttccccgtcctcccattccctaccgccgccgccgtcgccgccgcaccacccttccgacgacacc

SEQ ID NO: 588 - DNA, 89 bp, Setaria italica
ggcccaggctgtcgcctcgatctatataagcgagtgggaggagacgcgaaccctaagccgagcaccgcagaggaaggcgtcttcgtact

SEQ ID NO: 589 - DNA, 141 bp, Setaria italica
gctcaggttatttgcttgtactgcattcgcactcctaatgttaaattttgttggatggggcattatatttttcatatgcccaattcatcattcagtgtattgtgttgctaatactttttctgccaaacctttcaggatatt

SEQ ID NO: 590 - DNA, 555 bp, Setaria italica
aagcaggtttgatttctagatccactacatgaaccgtgtactgcttttcattggccatttcaatccttatgaaaatatgaactgaatgcgagctatgtggatttatgggcctgaggatattatgcatttcacagttcaacacaactgttgtgaataatttgggttgagtttaatcaaaactagtgcaatacatcaggaatttgtttatagacaatatgagcaactaaaggtgtggtagatctgaactaacggtgaagacaggtgatagtgcatcatgatcaactaaatgccatttgtaaacttcttaatacatttaagcaaaatttagatcaagtgcctaatgatgagccagaagaataagtgcaagcaactaacaatgcattactctgttgagttaattttcttgatccagttaaggtttgccattgagtggaccctcctttccctccttaatctttttgtgaactcgggccgttcctttcctatttagtagagctatataccagtcttaaatattcgtggtcgcttattctgccttgattgctccaggctttt

SEQ ID NO: 591 - DNA, 104 bp, Setaria italica
atcacggtatctccatcctagcatatttccacttaagtcctttttattttctggagtcatcgtgtatatatattcaaattccatttgcttggctctaggaggat

SEQ ID NO: 592 - DNA, 120 bp, Setaria italica
gcccaggttagatatctaacgaaaacaaacctaatttttttgtgtacatgttaatggattgatcatatatcttgtaaattgggattgattgttggtgttgcctttgtgttgtaggatatg

SEQ ID NO: 593 - DNA, 1012 bp, Setaria italica
aagcaggtctgcttctgctccctctgcctccctttactgtgcatggcatgtgaggtttcactgtatgagataatgtgttctagatttgcattgttggacacttggctgagcacataaatgcttttatcacctttttactttgttgaagacaggatttcctttgtttagtagaatatgatatcaaggaaataatttgtagctgctgatatatgaagtcatagattcatagatgctaacctttcttttaaaagacaatcaaggttgcaaggaaaacacagcaagtctgtgacatatatgctgtcagagtcttttatagccaatcaccggcttttgaatcatagtggtgtatactgaagtaatttgcatggcatgacaaattttgcaagacctgaactgtcggaatactattagcaaggtttagtgctattagcaaaaaagaaaaggcttagtgcatataatctgtgctagtttttgttcatgcgtaatcacggaaacggtacctcttactattaagtgtaacaagttctagtagaggcactgtttactttgaagtggcaacaatgtttcatatctcctcattttatgtttcaagttcgtgttcctgtttcatatttcaccccatttgtttattgcattttccatttatattcttaatctgtgaaatctaagatgcttaactgtctttgctgttggttctccactgaaattgacatgtcttgctgcatacatttctactttatattactaaattacaaccaaatggtgaaaattaacttagttatgctattacaaaactgtttattactgacagatggtctagaatacataaggcaccacatatgcataaccagctgtttctaattctaatttgtggaatttgctatgtttgtccaaaactgagacaatctcaattctcaactacattgcatcgaagtacgcttgatgttatgatatttttacttcacattttatttgctggagttgacttggaatttaatgtctgtaggctttt

SEQ ID NO: 594 - DNA, 105 bp, Setaria italica
accaatgtgagtttcctaattgtctttttaatctatttaaccttcttagttctctttgccatggttctcatctgaccttgttctctccttcaacttcaggaggat

SEQ ID NO: 595 - DNA, 163 bp, Setaria italica
gctcaggtttgttcattttttctgttctgataatatgacaactgtctctattcatctagtataggatgacaagttcatttctttgaatgcttagttgcttactgttagtctttacactgttttcttatgaagttttattctgctatgtattgtgtaggacatt

SEQ ID NO: 596 - DNA, 682 bp, Setaria italica
aagcaggttggaatcacatctacttttctactacatacattcgttttactgtgtttagggtgggttgttcgtgcatttgagcttgggcagaaaaaatatatccaaaagtgccttttaactgtaaattttaggatccttgtcctaattgttgagtatatcaggagctttctattgcttctcatacagcaaactaaacacttgtaggttcatgttgcaatttgactactagatatcttgatcactgtgtatcagatcagatagtttctgattagtaatgctacctctgatatgatgatagttctggtaatgctaccactgatatgatgagcttttgatcttccatgtttgcacatatctaaacaggcttgcttgtagtggttttgtgccattctgccctgttattgctagactcttgcttgttattatcctccttgttaaaagaattcttaatgttctactggattgtggtgatacttgtaatatctggcacctacattatcaaggtgataataatgctgtgtgttttacagttttgagtatctaatgccacttaattaatttgtggtaactgggaggcatttgagtcggttgcctgatcatttaactttttaattgtgacttagtccttatgccattgaaactttgataactgataacgattggctaatctttgcaggcgttt

SEQ ID NO: 597 - DNA, 105 bp, Setaria italica
ctcacggtaatttcttctcccaaaataaacctaatctttaatctgttgcctgtctactcttcctatctgttgctaaaaatttgaatttggtatgtgcaggaggat

SEQ ID NO: 598 - DNA, 1370 bp, Setaria italica
caggaggttagggttaccgatttgcctgtcccttctctcgagaaattaatcctgcgtgctgtcctgctgcttgatctcgttgtgcttcgtgttcgtggtacgctagatgcgtgggagtgccgcgaattttattcgatttttttgggggcgatgttctggcatgcggctagatccgctcgtctcgggcgttactgggtgggtttgcttggtctcgatctgcgagatctgaggcggggcgcgtagatccgtccgatttggcagtagtttggtgtgaggaccgaggaccttttgggttccccttctgtggtgagcggcttgtgtatgttggagggagtaaacggaggggatggaatgtggaatttctttagtcgaatgcgttcgtttatctgaatggttagcgtatacctggatatttgatctggatgcaggcgtactctgcaactagggtatctaagggtagtgcggtttgttgcagggaggtgttggggttgaattttctgttgatgaactattatgtgtgggattcgctagggatacaaaacctgttggtctgtgctgaaaatgtggtaggattaaatcattagatatctctgtggttagatctggctggcccatttcagtgatctgttagtctgtgatgtaaatagttcgtgtatgacttggatatgacatggattcttttaggtggtgtttggttggctcaaatgtaacgcaattcgattaccgaatgtaatgaatcacgttacagatgtttggttgtggtggtttgtaatcaattgacgctaattgaatcccttgcctatacaatacctatacaagcttgttacccctcctcccccactgtaattaacacccacgccgtaatctgattacgttactagagtgcaaccaaacaaagagggtaatcacccattccgccaccgaatacactaatctgattccctttgcgtttatgttaccttagcacgaaccaaacactatcttagtctcttgcatcatatcataatgtgttgacggtttgtttgattcaaatggatttggtattgtggaattatattgattattagtttgcttggagtcatatattactattttgaaccgcggattttttgtgctagcaccttgtgttagattagctgatgcctccttgtgtgactgtttgtcactggttgaatcagatttgtgtgaccctatcttgttgcttagaaatgtttagtcacattcttattttagcaaacatgagtgaaatgaatgacttgttgatttttatggccagcatgcacattttctgtatacctgagtaattttgtttagtttctactggcttttggcagcgactttatcagtttattttgttgttacagtaagcc

SEQ ID NO: 599 - DNA, 142 bp, Setaria italica
gctcaggtatgttcattttgctgctgggatgatagagtggtcactatattttcatgtcataaaagatgcccagttcatttgagtgcctagcgacactcttttcttagcaaactctaatctgctatgtaatgtgtaggatatt

SEQ ID NO: 600 - DNA, 600 bp, Setaria italica
aagcaggttggtatcacatctaccattctgttacatccattttgctctgtttatggtgcagactgtttgtggtgcactggaacctgaactcaagaatggaaccaaaagtacccttttaactgaaaattgtaggttccttattgtccttggctgtttagtataactggaggtcttgattgctcgtcatatgctagaccttttctctttttcacagttaggttcgtcaactaaaccatcttgaacccaatgtatcagatcagataatttctgattagtaatgttaatttttagttttcatatgatagcttgccctcttagctagctacatactacaattgaatttgcatgcttttagtgattgtgtcattctgtattctgctgtcattgctggactgattatcattggctctgttctgtgggattatgatgagacttgttgtatctggtgctcacattatcaaatgataatgattgtaactacaattcgtttactttgtccaagtaattggctgtcttgtgtgggttaccttaccagttaccagcttaagtctgtcattgcaagataattgatgctgatctactaatcctcttcaggcattt

SEQ ID NO: 601 - DNA, 601 bp, Setaria italica
aagcaggttggtatcacatctaccattctgttacatccattttgctctgtttatggtgcagactgtttgtggtgcactggaacctgaactcaagaatggaaccaaaagtacccttttaactgaaaattgtaggttccttattgtccttggctgtttagtataactggaggtcttgattgctcgtcatatgctagaaccttttctctttttcacagttaggttcgtcaactaaaccatcttgaacccaatgtatcagatcagataatttctgattagtaatgttaatttttagttttcatatgatagcttgccctcttagctagctacatactacaattgaatttgcatgcttttagtgattgtgtcattctgtattctgctgtcattgctggactgattatcattggctctgttctgtgggattatgatgagacttgttgtatctggtgctcacattatcaaatgataatgattgtaactacaattcgtttactttgtccaagtaattggctgtcttgtgtgggttaccttaccagttaccagcttaagtctgtcattgcaagataattgatgctgatctactaatcctcttcaggcattt

SEQ ID NO: 602 - DNA, 99 bp, Setaria italica
ctcacggtatttccttcccttccaagcttcatcatttgtcgcttatcgtctgctcaccttgaggtgctaaaaatcttaaattgctctctgcaggaggat

SEQ ID NO: 603 - DNA, 164 bp, Setaria italica
gctcaggttggtccatgttgtcacttccataacctgcttgcatttgattgttatttctgtgatagtattcttccatcatttccaagtgaccattgtttttcacttgttgactactggactgatatactcttaatgtgacttgccatgcaaatgtataggatatt

SEQ ID NO: 604 - DNA, 522 bp, Setaria italica
aagcaggtaggtattgcatttatctttcgatttgtcgtacaagtttctgagttgttattatcttgtttcatttgtttgaatctagtctggaataaaacatgcaaaattgcacttgttatgtcttccatagttcatcagaacagatggctcatgttggctttagtttgagttggattgtgatgtcctgtttgagtgcaacagttgtgcatcttgtctatggtgacataattacatattgcatgttcggtacagtgcttgttcttcatacgttggtatgataggcatttggcgcttatttgctacgcatactaatctaggaagcagtaaaaaccttgctagcagtagtagtagttctcttcatcatacatttcttaatattgttttttctataatgagctatcgagctagaagaattgcatagtattttcccctgattgagaagactgaattagtagaacagtttattttctaggtgttacaaatgcatgatacaacatgacatactattctttgcaggcattt

SEQ ID NO: 605 - DNA, 127 bp, Setaria italica
ctcacggtatctccgcactgccaaacttgagcttgtctaaatgaatgattgatgcctactcctggagtatggtgctgaggagtataaatctggatgtataatatgaatttctcggtggcaggaggat

SEQ ID NO: 606 - DNA, 1152 bp, Setaria italica
cgggaggttagggttcccgatttatccagctttcttttttgattgagaaattaatcttgcgtgctgtcaagagtgctgtcctgcttgatctagttgcgtgttgcgtgttcgtggtacgggagatacgggagtgcggcgggagtgcggcgagttttctccgccttttttcttcttctgttttttttcgggtggcgttctgcgatgcggctagatccgctttgtctcgggtgctggtccgtgggtttgttcgagctcgatccacgagatctgaggcttggagcgcacggggggcgtagatccgcctgatttgggaatagtttgatgcgaggactgaatgctgatcacctcccgggtttccgttcccattttggggttagcaaccgtgcctgttatctgttggaggcttggagcggggacacggatggttgaatgtagaatttctggagtgaagtagcttgttcagatatttgatctggatgtacacgtgccttcacggttagtagtgtattaaagggtagctctatctgttgctgctaggtgttggatgtgatttctcgatttatgtactgttcggtgtgtcggattttgggtcatgtttcacctgtttaaggaattatggttgggtaacctgttgatctggggttttgaatgatgatgaattgctgttgaattaaataattcattaatgataaccttgtcaaggatagatccggttggtccttttcagtgatctgtttggcagtagtttaaataggttagttctgtctgattgcttaatttgatggatttggggatcacaacagaatgaacagatcatattacctgcattgtgtggggtctgttattgcgatttttgaacctgaacgtgggtgctgtaagctagtgttcgattagatggtgctgcttggtgtggctgtattgcttttttgagaatggtgtggctttattgctggttcaatcaggtttgtatgaccctttcatatttctcagaaatgttattaataagcttgctcttaccaaacatggaggggcttaatggcttaagtcgagtttagtggccagccatgtacctttaccatgtagtcattttagttgatatcttgtacctttttgaggcaatggcttatcagttcccttttgttgcagtaagtt

SEQ ID NO: 607 - DNA, 818 bp, Setaria italica
gccgaggtacagtccagattcccgtctatcgatagttggaatgtcaccatctagatcaacttgctctgttttttcccctattttcttggtagcttgtagcgcagatgtgcgttatcacttatcaggttggtttaggtagatggtttcctgcccgtatttgtttcagcccccggactctgatttagccgagttgcatgaaggattcataaatattgctggaatctgaatgaatatgactgactggctgactgctccctagatacctgtagcttgtcaaagaaagaaactgaaaaacaattcggcatgtggaattagctgacgtgctacattacacaattctgcagcttttggtgagataggtggctgatcttactgcatggtgattccatttatgttaataccgttttatattttttaggatgatagtggctcaaagtctttttccttactttggatcatttgcaattgttgacagtagggtgcatttcgtttctatggatgctacattcatttatggtaatactgtttaataattttgaggaattcatttgatcacatgtagatttttaggatgatagtggctcaaaatcgttctccttacttttggatcatttgtaattgtcaaagtagagctgcaaaaacatgtgtttgctgctatttgaatgtttaattcatcaatcagtaatttatgcaggctagtattttctgaagagttacaacgtgatgtgtattttgataagaggacaatttcatagttgataaatgccttcaaagctcttttggttcagaggttaactttggttgaactttagtgtcag

SEQ ID NO: 608 - DNA, 84 bp, Setaria italica
gcccaggttagaccctttgaattgctcagttgtctgtttactctttgaaattctagagtctaattttccgtgctgcaggcattc

SEQ ID NO: 609 - DNA, 103 bp, Setaria italica
agcagtgtgtgtatcttctgccttgcttatgtttttgaactttgggtgcatttggtgtaatctaatttgaataaattcttttcattgttttgtgcaggcagat

SEQ ID NO: 610 - DNA, 1166 bp, Setaria italica
gggaaggtgcgaaaatgatctacagttttgcatttacataatatacttcttgaagcatatgtcatatgtgctatgcccagtagcttcaatatttttaaagctcttgtcctgagaactggattgctcaaaactattggaaacaaatctgacaagtgacaagctgcttgtttgtgttgagtgttggttgttgtagctttaacaacaaactgcttaacatatatgagtcttcctctaaagagagctattactcctagatttaaacttgtgagttttagacttggatgcatgaatcaaggacatagatgaaaatgagtttgttaccctacagttattcccttgtaggaaaagatactttatttatttatgacagtgatagcattcattcagcaagggcgtaaggtgtgaaaaagagagagaaaatgtgtctaaaagctttatgacttatatttagagaaaagttgagaagatctaccataaaggcaattggtgggaatagtaacttttagttgattggctgtacaccttccttgtggaagatagaaaacggtactcaatttacattatcctcataatgaacatgttgactagaaaaatgactgtatttgaaatgtagatggataaaatttactcagacctgtgcagtctgggacactagtgcttggttagtttgctgggtttttttccacgtatgatagatcatctgtagctcttctgcaattaagtcatattttggacatagtgagcacatttgtatctgtattactcaatgtgtataggatttccctgataatagatactgggaattgagtaaaattgttttattttttcaaaatacatcaagcatgtattttgttctaaaacatgacctttggtgagtgattaggcatgcatatttatttgaaaccttgtttattgtattatgggcatttgtaggaactgaacctgaagggcattttattttatttagcaccttgctagtttttaagagatgtttttatttatttagtccagagtttctactaatccttaggcttcaagttggtatgtagcattataaatgattgagaatgattactttttacagttgtattgttatatttcctgttaatgcttgatcagctgtcatgacttcatttttactctgtgctaatttgatttaggatgtt

SEQ ID NO: 611 - DNA, 159 bp, Setaria italica
gctcaggtgagcagagctccaatccctctcctatcttctcccgtctcgtcgcttcatctggctgttttcttatcttggaactgatgctctgtgtgtgtgattggggatgcttctccggtgtctgatgtatttgcgctcgttgatgcctcgcaggctttc

SEQ ID NO: 612 - DNA, 92 bp, Setaria italica
tgctatgtaagccgccggtatcttcctataatcacttgtgagatttagttgcctgtggtgtgaccttcggtggtgatgctttgcagccagat

SEQ ID NO: 613 - DNA, 564 bp, Setaria italica
ggcaaggtgaatttcgcttgttttgttgtgctattgtggtgcatagcttgtaatgttcagttactgactatgcttgaataattttaatgggcctagagatcgtgcatgaggttacttgcatcataagtagtagatgtatcattagtaaggaatgcggcactgaatataccatcatcatgcatggcttgaattttgaacagttcagttacagtatatcctttttaatccatcgagtatctgaattgagtgacagatgaagaatcaatgctgtttgtgtaggctatattatcatccagtaattgtttgagtactccttcctagaaatttgcagaatttcttcttggcccgggttatcttttcagtgcttgtgatgttaatacatgttactttagtatttgctttgtgttttgagttgttattccatacgtcgattttggtgccatggcatatagagtggaaacttttggctaagtgatactgtttggtgtgctcctctataattgtatacaggtttccaataattgaacataatttgatcattctttttgcttgacttaggatgtt

SEQ ID NO: 614 - DNA, 564 bp, Setaria italica; identical to SEQ ID NO: 613

SEQ ID NO: 615 - DNA, 142 bp, Setaria italica
caccaggtagcgagccatccgcctgtcctctcctcttctgctgctgatccgctttcaaatccccgttggatttgttccgcggtgttgacatcaccgcctcgcctcatctttgccgcgtttgttttcctgtctacaggtggat

SEQ ID NO: 616 - DNA, 286 bp, Setaria italica
catgaggtacctacccaccaccaatctttgtgcccccgttcttcctctccagttttttcttgttggatcgtccatttgtcacttgatcaccctggatcttcttggatcatgattgaaattattaatattcagtatcacccttgtccgtcacttctgaattccatctgtcgcttctgatagagtgatagttgctgttcagttgccccgttagtcttgcacacaccacatccacttcatctctgacacactgtactcattttgactgcgctctgctttgcagtaagtt

SEQ ID NO: 617 - DNA, 747 bp, Setaria italica
gaggaggtacttatgatgatgctgttcttccatccttttccttgagcaaaatgtcgttgctattggattgtgattctcaaactgtggtagaaccttcttagcatgcagttgactattgtgaaatgagactgaccatcttactgcattttgatatccagatacatgctacaaaacatgtacattgtttgaaatttgatcccaaacctttgaactgaatatatgctgtcttctctgtacaaagttttttttagattggttgtgatgttgtgttgtcttctgtgtgcaggctgagaagatcggtcttgattacatggatgttgaagctcttaaaaagatgaacaagaacaagaagcttgtcaagaagcttgccaagaagtaccatgctttcttagcctccgaggctattatcaagcagattcctcgtctccttggtcctggtctcaacaaggcaggtaagtattctgctctgtcaacatctggctgtcatccttcatagttagaaatgagctttatctgttcttaccgcaatctgtgttgtacattcctactattgtagttatatctaatatgtaatggctctggtactgttctgtggaaaggtatttatcagcctcattttgttactatgttttcagtttcatgtgtggcattcccttagcctatacatatacgaagatataacttatttttgtacagcttagctgtatctgcaagattttgaagcttgttggctttttgcagctccac

SEQ ID NO: 618 - DNA, 152 bp, Setaria italica
cagaacgtgagtcatgcatgcttttaaccctaccttgttttaccttttctttctgttgcatcttgtgtgtccactgaatacgtgtcagagcaaacaactgatgttaatccgaagctaactcaggcctgtgattttttgttttgcaggtgagg

SEQ ID NO: 619 - DNA, 1068 bp, Setaria italica
  misc_feature (441)..(501): k= g or t; r= g or a; w= a or t.
tggtccaaaccctttgctgaattgtagtacttctcctcccatagatcgcttcaccaggttccgatttgcggtctcttgtgaatttttttgtggtttccgcgtccagcggtgctgttttctcgtggtttatttggtgcgcggtcgatcccttcgcagggcaaagaaattcgctggatgtttagttgatgcgctatcctgctgcgtggtatagcctgtagtagaattgtgctatggcgctgtcactatcgaaatattaggtccacccgtgtgccagtggtgagctcctaacggacgttttagcagaaaaaaacaagaagctgtgaattaacctgaaaatcgtaaaaactgctgctgtgagcctttcggttccacgctgatctgtagttgccaggggccaggggggtggtacttagtgtatcagtgtgcagtaatgactttgakgaatgcatacccattagcarcagwaaaggctaaattatgtagacacaatgtttttcgctwttttttgacaaatatctcccaaatgagttctttgtttattgcgaatccatatgtgatgaataatgatatctgctttattttataaaaccgagatcactggggagcagaattttttctattaagtccacctgtgtgacagtggtgagctagtaataaactttttagcagaaaataaagaacctgggaaattaacctcaaatcatagaaactgctgctgtgatcctttcggtttccagctgtgcagtaatgatttgatgaatacatacatataggaatagtaaggccaaattgtgtagataaatttttgctgttcggacaaatctctccaagagtagttctccgttcctcaagaaaaccttgtgtgatgaatgatgatatctgctttattttagaaaactatcagttgagagcagagtttgtctgatccaatgtacgcgaatatacacatggcacaagcaaaggaaaaataattgttgatttttttaaccatgaaaagaaggggtatttgattcccggtccaggcaacataactagtattgaaaattctgcatttttctctgaatgtgt

SEQ ID NO: 620 - DNA, 1060 bp, Setaria italica
tggtccaaaccctttgctgaattgtagtacttctcctcccatagatcgcttcaccaggttccgatttgcggtctcttgtgaatttttttgtggtttccgcgtccagcggtgctgttttctcgtggtttatttggtgcgcggtcgatcccttcgcagggcaaagaaattcgctggatgtttagttgatgcgctatcctgctgcgtggtatagcctgtagtagaattgtgctatggcgctgtcactatcgaaatattaggtccacccgtgtgccagtggtgagctcctaacggacgttttagcagaaaaaacaagaagctgtgaattaacctgaaatcgtagaaactgctgctgtgagcctttcggttccacgctgatctgtagttgccagggcccagggggtggtacttagtgtatcagtgtgcagtaatgacttgatgaatgcatacacatagcagcagtaaaggctaaattatgtagacacaatgttttcgctattttgacaaatatctcccaaatgagttctttgtttattgcgaatccatatgtgatgaataatgatatctgctttattttataaaaccgagatcactggggagcagaattttttctattaagtccacctgtgtgacagtggtgagctagtaataaactttttagcagaaaataaagaacctgggaaattaacctcaaatcatagaaactgctgctgtgatcctttcggtttccagctgtgcagtaatgatttgatgaatacatacatataggaatagtaaggccaaattgtgtagataaatttttgctgttcggacaaatctctccaagagtagttctccgttcctcaagaaaaccttgtgtgatgaatgatgatatctgctttattttagaaaactatcagttgagagcagagtttgtctgatccaatgtacgcgaatatacacatggcacaagcaaaggaaaaataattgttgatttttttaaccatgaaaagaaggggtatttgattcccggtccaggcaacataactagtattgaaaattctgcatttttctctgaatgtgt

SEQ ID NO: 621 - DNA, 1120 bp, Setaria italica
gaacaggtgattctcctcccctcatctctctggtccaaaccctttgctgaattgtagtacttctcctcccatagatcgcttcaccaggttccgatttgcggtctcttgtgaatttttttgtggtttccgcgtccagcggtgctgttttctcgtggtttatttggtgcgcggtcgatcccttcgcagggcaaagaaattcgctggatgtttagttgatgcgctatcctgctgcgtggtatagcctgtagtagaattgtgctatggcgctgtcactatcgaaatattaggtccacccgtgtgccagtggtgagctcctaacggacgttttagcagaaaaaacaagaagctgtgaattaacctgaaatcgtagaaactgctgctgtgagcctttcggttccacgctgatctgtagttgccagggcccagggggtggtacttagtgtatcagtgtgcagtaatgacttgatgaatgcatacacatagcagcagtaaaggctaaattatgtagacacaatgttttcgctattttgacaaatatctcccaaatgagttctttgtttattgcgaatccatatgtgatgaataatgatatctgctttattttataaaaccgagatcactggggagcagaattttttctattaagtccacctgtgtgacagtggtgagctagtaataaactttttagcagaaaataaagaacctgggaaattaacctcaaatcatagaaactgctgctgtgatcctttcggtttccagctgtgcagtaatgatttgatgaatacatacatataggaatagtaaggccaaattgtgtagataaatttttgctgttcggacaaatctctccaagagtagttctccgttcctcaagaaaaccttgtgtgatgaatgatgatatctgctttattttagaaaactatcagttgagagcagagtttgtctgatccaatgtacgcgaatatacacatggcacaagcaaaggaaaaataattgttgatttttttaaccatgaaaagaaggggtatttgattcccggtccaggcaacataactagtattgaaaattctgcatttttctctgaatgtgtactgaacattgatctctgttacagaaaact

SEQ ID NO: 622 - DNA, 1120 bp, Setaria italica
caacaggtgattctcctcccctcatctctctggtccaaaccctttgctgaattgtagtacttctcctcccatagatcgcttcaccaggttccgatttgcggtctcttgtgaatttttttgtggtttccgcgtccagcggtgctgttttctcgtggtttatttggtgcgcggtcgatcccttcgcagggcaaagaaattcgctggatgtttagttgatgcgctatcctgctgcgtggtatagcctgtagtagaattgtgctatggcgctgtcactatcgaaatattaggtccacccgtgtgccagtggtgagctcctaacggacgttttagcagaaaaaacaagaagctgtgaattaacctgaaatcgtagaaactgctgctgtgagcctttcggttccacgctgatctgtagttgccagggcccagggggtggtacttagtgtatcagtgtgcagtaatgacttgatgaatgcatacacatagcagcagtaaaggctaaattatgtagacacaatgttttcgctattttgacaaatatctcccaaatgagttctttgtttattgcgaatccatatgtgatgaataatgatatctgctttattttataaaaccgagatcactggggagcagaattttttctattaagtccacctgtgtgacagtggtgagctagtaataaactttttagcagaaaataaagaacctgggaaattaacctcaaatcatagaaactgctgctgtgatcctttcggtttccagctgtgcagtaatgatttgatgaatacatacatataggaatagtaaggccaaattgtgtagataaatttttgctgttcggacaaatctctccaagagtagttctccgttcctcaagaaaaccttgtgtgatgaatgatgatatctgctttattttagaaaactatcagttgagagcagagtttgtctgatccaatgtacgcgaatatacacatggcacaagcaaaggaaaaataattgttgatttttttaaccatgaaaagaaggggtatttgattcccggtccaggcaacataactagtattgaaaattctgcatttttctctgaatgtgtactgaacattgatctctgttacaggaaact

SEQ ID NO: 623 - DNA, 499 bp, Setaria italica
actccggtaacgatcttcgccactcattcaccctgtgtccctcgctagagtctccccttcctccataccgccgccccgcgcgggcgcggtacggtgctctcagatccgcccggcattgctcgctcgggccgatccgatctcgcatttgcgcgctcccgccgcggatccggccggatctcgcggaaatggggcgcgggtttctttggcatgctgtagatctgcttgtttcggctcgtgatctggaggcgccgcgggcgtttcggtaacgaaatgacctgatctgtggtggggttggggaatgccatttattagttcgttaattgctggttttctggtatcttattgggagggttcaattgatgcctttagagtagattttgtatgtagagcaaacaatggaaacaaatcatcgatagctttgcaatttgcctgctttgcttatttaattcctgcttgatttgacaaatgtggcatcgtgcgagctttcctgtaggtagaa

SEQ ID NO: 624 - DNA, 622 bp, Setaria italica
ttcaccgtaagcgagcgctctctccctcgctctcttctggtcctctacgacgctgctctctgttcttgttagcttctagatcttgctctccgttcactccaaggcttggtcttgcgaccttgcgggcccggatctgagtagcctgggcgaagatcgggccaaaaatcgtatctttcatcggttcatttcctccttaggatcaaggaatccatgctctaggatgctcctagattgttccacaaattgacacagtggaaacatgctgctgtgaaattcattcagactttatgggtcagaaattgttctctgggaactatataacttagtcagtgccaggggtattacataaattgcttttgttttctgacattttttcttgtaggctgctgtgaaattcagacattatgggttagaagttgttgtttaggaactatataacttaaccagtgccaggggtattgcataaattgctttgttttctgacattttttcttgtacgcatcaagttaatgctttcaattaaaatgcatttgcatgttcaatgttcctttataccatgtattgagctaaggaaacctttcatcacaaactgattctcttcatatgccacttgcagttattc

SEQ ID NO: 625 - DNA, 622 bp, Setaria italica
ttcaccgtaagcgagcgctctctccctcgctctcttctggtcctctacgacgctgctctctgttcttgttagcttctagatcttgctctccgttcactccaaggcttggtcttgcgaccttgcgggcccggatctgagtagcctgggcgaagatcgggccaaaaatcgtatctttcatcggttcatttcctccttaggatcaaggaatccatgctctaggatgctcctagattgttccacaaattgacacagtggaaacatgctgctgtgaaattcattcagactttatgggtcagaaattgttctctgggaactatataacttagtcagtgccaggggtattacataaattgcttttgttttctgacattttttcttgtaggctgctgtgaaattcagacattatgggttagaagttgttgtttaggaactatataacttaaccagtgccaggggtattgcataaattgctttgttttctgacattttttcttgtacgcatcaagttaatgctttcaattaaaatgcatttgcatgttcaatgttcctttataccatgtattgagctaaggaaacctttcatcacaaactgattctcttcatatgccacttgcaggtactc

SEQ ID NO: 626 - DNA, 1365 bp, Setaria italica
tccccggtaatctcctcctccccctcccctccgctccctggagcccctctactcgcgatctccccacgcactagctcctgctccagcatttttcgagtgtttggcgctcagatctgagcggcctggctcgagatctgcggtttgctcatgcgttctggtcacttgcctccggtgctcccgccagatccggggcgggtaccgcgcgatccgccagcggatcgtgcttcgtggttggtgctagggtgttcgtctgacgtctgtgcttgatgaactccgtcctgttcctgatctgtagcgtttctgcgtgccgatgcgtctgattttgtgcgcacgcctgatgtgtgtttgcgggactgccgtgcgaggaggctctctgagctacgtacctaggaatggtgactgtgatgtgcctgaatgcgcttacgtgttgctggcgatgcacgagcccttggggtgtgactgcttgactacttcccagctccgacgttctagtttcctgcttgactgggagtctgggagagcttcgtgatgctctgtctagcaagtccagatagttgcggtaactggtaacatggttggatgaaagtcgcggatagttaatttggtgtgattgaactaccagagtgtaaaaatccgtgtgtggttcattcggagagagctatttggaaagcatatctgcatgttaggatgtttccttgtcatgaatagctattgagcacataccacccaaaattagtgacaacttagtgatgtttcatggcaccaaatgttaggctgaaaagttcagcatgtgatttttgttgctctgcaggtcacattttagacaacaaaaaagcttgttagattggccagtacatgtacactactttttcaaagcaatgctagtcttttcctatcatgtttagttatacgaatgtttggttatggtactttacacatttttataaatgttggaaacaacagtccgcaagttatcagattatttcttactctctccgttccaaattgtaggtcgttttgacttttgtaggttcatagatattattatgcatctagatatagtgtatgtctaggtgcataataatatctatgaatctagaaaagtcaaaacgacctacaatttggaacggagggagtacaacattagcctagtcggtgaaatgaatcccacttttgcctggcagtaagctctgtacatatgttgtttttattgacttatagatgcacaaatataaaggttcagttgatatgccttcaaaacttttatgtttacgatgcttactggttcccttgtacagctactatctagcaggatacacttgctgttaactgataccccttttttgctacctcttgcagagtacc

SEQ ID NO: 627 - DNA, 1365 bp, Setaria italica
tccccggtaatctcctcctccccctcccctccgctccctggagcccctctactcgcgatctccccacgcactagctcctgctccagcatttttcgagtgtttggcgctcagatctgagcggcctggctcgagatctgcggtttgctcatgcgttctggtcacttgcctccggtgctcccgccagatccggggcgggtaccgcgcgatccgccagcggatcgtgcttcgtggttggtgctagggtgttcgtctgacgtctgtgcttgatgaactccgtcctgttcctgatctgtagcgtttctgcgtgccgatgcgtctgattttgtgcgcacgcctgatgtgtgtttgcgggactgccgtgcgaggaggctctctgagctacgtacctaggaatggtgactgtgatgtgcctgaatgcgcttacgtgttgctggcgatgcacgagcccttggggtgtgactgcttgactacttcccagctccgacgttctagtttcctgcttgactgggagtctgggagagcttcgtgatgctctgtctagcaagtccagatagttgcggtaactggtaacatggttggatgaaagtcgcggatagttaatttggtgtgattgaactaccagagtgtaaaaatccgtgtgtggttcattcggagagagctatttggaaagcatatctgcatgttaggatgtttccttgtcatgaatagctattgagcacataccacccaaaattagtgacaacttagtgatgtttcatggcaccaaatgttaggctgaaaagttcagcatgtgatttttgttgctctgcaggtcacattttagacaacaaaaaagcttgttagattggccagtacatgtacactactttttcaaagcaatgctagtcttttcctatcatgtttagttatacgaatgtttggttatggtactttacacatttttataaatgttggaaacaacagtccgcaagttatcagattatttcttactctctccgttccaaattgtaggtcgttttgacttttgtaggttcatagatattattatgcatctagatatagtgtatgtctaggtgcataataatatctatgaatctagaaaagtcaaaacgacctacaatttggaacggagggagtacaacattagcctagtcggtgaaatgaatcccacttttgcctggcagtaagctctgtacatatgttgtttttattgacttatagatgcacaaatataaaggttcagttgatatgccttcaaaacttttatgtttacgatgcttactggttcccttgtacagctactatctagcaggatacacttgctgttaactgataccccttttttgctacctcttgcagggtagc

SEQ ID NO: 628 - DNA, 1205 bp, Setaria italica
  misc_feature (576)..(1070): r= g or a; y= t or c; n= g, c, t or a.
  unsure (1)..(1205): unsure at all n locations
tttcaggtgagcgcatcgaggtccccttctgtttatactcctttaatgctgctgtttcttgttgctgccgaggatgtttagatgtctaggggctgggttgggtggtagggtgcagtggggttcgccgatcgtcttgggttctggttggctatcaggggctggatccgtagtaggagtaagggccgcaatgttgctgagactttcttggtgacttgtgtggatgcttcgatcttgtgtgttgaggtggactagtagtattgacagtatatcccttggtaattttgtgatatggtattagtttgtgctaatggatgcctggttcttctgaattgcaagtgaattccgcagggttccttgtgcttagaaatggaatttgtgatcttagtgttcagacagagtcactttgcttcaagtcaccaccgacgtattagttttcaatttttgagcaaattttgtgcttctatagaatacggttacaaacaattatagccagatattacttctttgacttcttaaattgttaagaaaattgttccaagatcgaaaatctccctttccacgaatcatgtagatggrtactctttyccccccnaaagagaaacaggtcatgatttttaatatattggaaattgatgcgcatggtctggatagcttcagctgctgatgcctagcggtccttctgatccgaaaatgctaaattcttcagatcgtcagctgtgaggaatcatgaatttggttcctgcaattgaccatgtgtttgactaaatccttcatggattggcgaatgccttgcactattacaccaagagtttgcatgcactggacagcctgatttgtttgtatacatgcaactgaaacctaactacttattaataccagctggaaagcgaacggttttggtgttgtaagactagctgttgctgtttacaactatttttttcttttgtttgaatatagtccctgttacagttagaattgcttgtatagttgtatttggcttcctgtttgataagtactctaaaggaatgtttagaggtattaggatctttttctcagttaatagatttagyctgtcaagatgtaactctagtcttctgttgatagtaggaagaccaactttttctcttcttgctgaagtaactttagcgcatattggtctaagtcttggtaaatgctgttttcattcttgaacattgcagatcatt

SEQ ID NO: 629 - DNA, 1202 bp, Setaria italica
  misc_feature (1067)..(1067): y= t or c.
tttcaggtgagcgcatcgaggtccccttctgtttatactcctttaatgctgctgtttcttgttgctgccgaggatgtttagatgtctaggggctgggttgggtggtagggtgcagtggggttcgccgatcgtcttgggttctggttggctatcaggggctggatccgtagtaggagtaagggccgcaatgttgctgagactttcttggtgacttgtgtggatgcttcgatcttgtgtgttgaggtggactagtagtattgacagtatatcccttggtaattttgtgatatggtattagtttgtgctaatggatgcctggttcttctgaattgcaagtgaattccgcagggttccttgtgcttagaaatggaatttgtgatcttagtgttcagacagagtcactttgcttcaagtcaccaccgacgtattagttttcaatttttgagcaaattttgtgcttctatagaatacggttacaaacaattatagccagatattacttctttgacttcttaaattgttaagaaaattgttccaagatcgaaaatctcctttccacgaatcatgtagatgggactcttttccccccaaaagagaacaggtcatgatttttaatatattggaaattgatgcgcatggtctggatagcttcagctgctgatgcctagcggtccttctgatccgaaaatgctaaattcttcagatcgtcagctgtgaggaatcatgaatttggttcctgcaattgaccatgtgtttgactaaatccttcatggattggcgaatgccttgcactattacaccaagagtttgcatgcactggacagcctgatttgtttgtatacatgcaactgaaacctaactacttattaataccagctggaaagcgaacggttttggtgttgtaagactagctgttgctgtttacaactatttttttcttttgtttgaatatagtccctgttacagttagaattgcttgtatagttgtatttggcttcctgtttgataagtactctaaaggaatgtttagaggtattaggatctttttctcagttaatagatttagyctgtcaagatgtaactctagtcttctgttgatagtaggaagaccaactttttctcttcttgctgaagtaactttagcgcatattggtctaagtcttggtaaatgctgttttcattcttgaacattgcagatcatt

SEQ ID NO: 630 - DNA, 1202 bp, Setaria italica
tttcaggtgagcgcatcgaggtccccttctgtttatactcctttaatgctgctgtttcttgttgctgccgaggatgtttagatgtctaggggctgggttgggtggtagggtgcagtggggttcgccgatcgtcttgggttctggttggctatcaggggctggatccgtagtaggagtaagggccgcaatgttgctgagactttcttggtgacttgtgtggatgcttcgatcttgtgtgttgaggtggactagtagtattgacagtatatcccttggtaattttgtgatatggtattagtttgtgctaatggatgcctggttcttctgaattgcaagtgaattccgcagggttccttgtgcttagaaatggaatttgtgatcttagtgttcagacagagtcactttgcttcaagtcaccaccgacgtattagttttcaatttttgagcaaattttgtgcttctatagaatacggttacaaacaattatagccagatattacttctttgacttcttaaattgttaagaaaattgttccaagatcgaaaatctcctttccacgaatcatgtagatgggactcttttccccccaaaagagaacaggtcatgatttttaatatattggaaattgatgcgcattgtctggatagcttcagctgctgatgcctagcggtccttctgatccgaaaatgctaaattcttcagatcgtcagctgtgaggaatcatgaatttggttcctgcaattgaccatgtgtttgactaaatccttcatggattggcgaatgccttgcactattacaccaagagtttgcatgcactggacagcctgatttgtttgtatacatgcaactgaaacctaactacttattaataccagctggaaagcgaacggttttggtgttgtaagactagctgttgctgtttacaactatttttttcttttgtttgaatatagtccctgttacagttagaattgcttgtatagttgtatttggcttcctgtttgataagtactctaaaggaatgtttagaggtattaggatctttttctcagttaatagatttagtctgtcaagatgtaactctagtcttctgttgatagtaggaagaccaactttttctcttcttgctgaagtaactttagcgcatattggtctaagtcttggtaaatgctgttttcattcttgaacattgcagatcatt

SEQ ID NO: 631 - DNA, 1202 bp, Setaria italica
cttcaggtgagcgcatcgaggtccccttctgtttatactcctttaatgctgctgtttcttgttgctgccgaggatgtttagatgtctaggggctgggttgggtggtagggtgcagtggggttcgccgatcgtcttgggttctggttggctatcaggggctggatccgtagtaggagtaagggccgcaatgttgctgagactttcttggtgacttgtgtggatgcttcgatcttgtgtgttgaggtggactagtagtattgacagtatatcccttggtaattttgtgatatggtattagtttgtgctaatggatgcctggttcttctgaattgcaagtgaattccgcagggttccttgtgcttagaaatggaatttgtgatcttagtgttcagacagagtcactttgcttcaagtcaccaccgacgtattagttttcaatttttgagcaaattttgtgcttctatagaatacggttacaaacaattatagccagatattacttctttgacttcttaaattgttaagaaaattgttccaagatcgaaaatctcctttccacgaatcatgtagatgggactcttttccccccaaaagagaacaggtcatgatttttaatatattggaaattgatgcgcattgtctggatagcttcagctgctgatgcctagcggtccttctgatccgaaaatgctaaattcttcagatcgtcagctgtgaggaatcatgaatttggttcctgcaattgaccatgtgtttgactaaatccttcatggattggcgaatgccttgcactattacaccaagagtttgcatgcactggacagcctgatttgtttgtatacatgcaactgaaacctaactacttattaataccagctggaaagcgaacggttttggtgttgtaagactagctgttgctgtttacaactatttttttcttttgtttgaatatagtccctgttacagttagaattgcttgtatagttgtatttggcttcctgtttgataagtactctaaaggaatgtttagaggtattaggatctttttctcagttaatagatttagtctgtcaagatgtaactctagtcttctgttgatagtaggaagaccaactttttctcttcttgctgaagtaactttagcgcatattggtctaagtcttggtaaatgctgttttcattcttgaacattgcaggtcatc

SEQ ID NO: 632 - DNA, 1017 bp, Setaria italica
gccaaggtatagccgggtttccccttgctctcgcaccgatttgatcggaggaaacgatcggtcgtaggcaagattcggttcgattgatcgccgcgcgacgttcctgtccgagttgacttcgatttccatgtgaattttgctgtatttggctgttctttttttgtctgaccccagcataacgagcaagaatcgccggcatatgtgtactatgtgtgctaatttctgcctctgcggtgttcgatcggattctctttttgtgtgatgtaccttacggcccagtcaattttgcacgagattatactatataacttagcaagtgctgataccatggtaggatgtgctaagataggatgtggcctagcgatccctgatgggtgctatgctaattcgttgcaattgccaaatagcggaaattatatccaggatactctgtgaagaactggagatgatctaaagctgcgaaatcacagtgcttgtgtccaaattcgattaaccattttcagccaaaatagaagcagtgaggtttcagccgatacatcaatcaacgtagataggtggtatttgttggcagtaattttctctgctaccgtgcatgtgtgtgttttatcattgcgaataaaaaacagagctccgatgtgtcgtgtatattatgtcaccgaacttgatgccaatcaagataggaataatttgtattatcagccaccactaaggtccagtcaatcactgcaaattgctcgaaagcttatacttgcataagtcaagtagcagtttcttaatcatgaatatgttcctcaaaaaaatagtatctgaatatttgtttttgactgatgagtggtataccgcactttgatgtcatcataccattttatggcttttacttgggtccgtggaccactcaagctgtgtgacgcttttaacaccactgcagaatgcactgaatttgaatacattctgaatattattattatcgaaacatacattctgatttctgcatacaactttctgctgcagaaaact

SEQ ID NO: 633 - DNA, 1018 bp, Setaria italica
gccaaggtatagccgggtttccccttgctctcgcaccgatttgatcggaggaaacgatcggtcgtaggcaagattcggttcgattgatcgccgcgcgacgttcctgtccgagttgacttcgatttccatgtgaattttgctgtatttggctgttctttttttgtctgaccccagcataacgagcaagaatcgccggcatatgtgtactatgtgtgctaatttctgcctctgcggtgttcgatcggattctctttttgtgtgatgtaccttacggcccagtcaattttgcacgagattatactatataacttagcaagtgctgataccatggtaggatgtgctaagataggatgtggcctagcgatccctgatgggtgctatgctaattcgttgcaattgccaaatagcggaaattatatccaggatactctgtgaagaactggagatgatctaaagctgcgaaatcacagtgcttgtgtccaaattcgattaaccattttcagccaaaatagaagcagtgaggtttcagccgatacatcaatcaacgtagataggtggtatttgttggcagtaattttctctgctaccgtgcatgtgtgtgttttatcattgcgaataaaaaaacagagctccgatgtgtcgtgtatattatgtcaccgaacttgatgccaatcaagataggaataatttgtattatcagccaccactaaggtccagtcaatcactgcaaattgctcgaaagcttatacttgcataagtcaagtagcagtttcttaatcatgaatatgttcctcaaaaaaatagtatctgaatatttgtttttgactgatgagtggtataccgcactttgatgtcatcataccattttatggcttttacttgggtccgtggaccactcaagctgtgtgacgcttttaacaccactgcagaatgcactgaatttgaatacattctgaatattattattatcgaaacatacattctgatttctgcatacaactttctgctgcagaaaact

SEQ ID NO: 634 - DNA, 1018 bp, Setaria italica
accaaggtatagccgggtttccccttgctctcgcaccgatttgatcggaggaaacgatcggtcgtaggcaagattcggttcgattgatcgccgcgcgacgttcctgtccgagttgacttcgatttccatgtgaattttgctgtatttggctgttctttttttgtctgaccccagcataacgagcaagaatcgccggcatatgtgtactatgtgtgctaatttctgcctctgcggtgttcgatcggattctctttttgtgtgatgtaccttacggcccagtcaattttgcacgagattatactatataacttagcaagtgctgataccatggtaggatgtgctaagataggatgtggcctagcgatccctgatgggtgctatgctaattcgttgcaattgccaaatagcggaaattatatccaggatactctgtgaagaactggagatgatctaaagctgcgaaatcacagtgcttgtgtccaaattcgattaaccattttcagccaaaatagaagcagtgaggtttcagccgatacatcaatcaacgtagataggtggtatttgttggcagtaattttctctgctaccgtgcatgtgtgtgttttatcattgcgaataaaaaaacagagctccgatgtgtcgtgtatattatgtcaccgaacttgatgccaatcaagataggaataatttgtattatcagccaccactaaggtccagtcaatcactgcaaattgctcgaaagcttatacttgcataagtcaagtagcagtttcttaatcatgaatatgttcctcaaaaaaatagtatctgaatatttgtttttgactgatgagtggtataccgcactttgatgtcatcataccattttatggcttttacttgggtccgtggaccactcaagctgtgtgacgcttttaacaccactgcagaatgcactgaatttgaatacattctgaatattattattatcgaaacatacattctgatttctgcatacaactttctgctgcaggaaact

SEQ ID NO: 635 - DNA, 408 bp, Setaria italica
ttgctggtaaggaagccctacctttctatggttgttttttttatttcattctgttctgcggtggatggatctcctgttcgctgcgaatgagcgctccaatccgaatccttgttgttgctggtatgggtgctccgattcgtctatctcgtggcggatttattcgctgcgcggcggagtagtagttggatcagtttgtttcccagtttttttgttaggattatgaagaaaggtttatggggaacggaaggtttacgtgccacaataaactgcagcaagcagcctcactggaagtggtagcttgcctgcagaatttatttgataggattacctttcacgggctaaataagcagattctgattagtaggagtacccttcttatgcttgaatctgttgatgcaacagaacaac

SEQ ID NO: 636 - DNA, 1418 bp, Setaria italica
  misc_feature (1)..(1418): n=a, c, g or t.
  unsure (1)..(1418): unsure at all n locations
tccccggtaatctcctcctccccctcccctccgctccctggagcccctctactcgcgatctccccacgcactagctcctgctccagcatttttcgagtgtttggcgctcagatctgagcggcctggctcgagatctgcggtttgctcatgcgttctggtcacttgcctccggtgctcccgccagatccggggcgggtaccgcgcgatccgccagcggatcgtgcttcgtggttggtgctagggtgttcgtctgacgtctgtgcttgatgaactccgtcctgttcctgatctgtagcgtttctgcgtgccgatgcgtctgattttgtgcgcacgcctgatgtgtgtttgcgggactgccgtgcgaggaggctctctgagctacgtacctaggaatggtgactgtgatgtgcctgaatgcgcttacgtgttgctggcgatgcacgagcccttggggtgtgactgcttgactacttcccagctccgacgttctagtttcctgcttgactgggagtctgggagagcttcgtgatgctctgtctagcaagtccagatagttgcggtaactggtaacatggttggatgaaagtcgcggatagttaatttggtgtgattgaactaccagagtgtaaaaatccgtgtgtggttcattcggagagagctatttggaaagcatatctgcatgttaggatgtttccttgtcatgaatagctattgagcacataccacccaaaattagtgacaacttagtgatgtttcatggcaccaaatgttaggctgaaaagttcagcatgtgatttttgttgctctgcaggtcacattttagacaacaaaaaagcttgttagattggccagtacatgtacactactttttcaaagcaatgctagtcttttcctatcatgtttagttatacgaatgtttggttatggtactttacacatttttataaatgttggaaacaacagtccgcaagttatcagattatttcttactctctccgttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgacctacaatttggaacggagggagtacaacattagcctagtcggtgaaatgaatcccacttttgcctggcagtaagctctgtacatatgttgtttttattgacttatagatgcacaaatataaaggttcagttgatatgccttcaaaacttttatgtttacgatgcttactggttcccttgtacagctactatctagcaggatacacttgctgttaactgataccccttttttgctacctcttgcagagtacc

SEQ ID NO: 637 - DNA, 614 bp, Setaria italica
atccaggtatgccccgccgattctctaacgttagatccctttgcgcatcctgtcttctggtcgttacagcgatctggctgttcgttctagggttgtatttgctccaaaatgcgtgttttgctagtcttgtgacgccatattagtcggtagatttggtctcgtagaaatgggatgatggtttgcaaatgtttgtttggtggtagtttttcaggtccaaccgtcccgagtgagatggtaaatcaggcgcttagccgtcagattgtatgctgaccattaggatttacttgaatcgtttagagcatatttaatggaattattagcgtggcttacaagctgcgaagacgtggttaagatttgatgagtgctgttctagactgtacgtgtcttagattatttcaattcatgtatccaaaattttgaaattttcagcttcattattgtatgatgatggattcgtgtgttgtcaactagattgtaagctaatttgtataatcttttggttgggttttgctgatggtactctattgttacgctatcacttaatctagctccttttatgcctgaaaaaaatggactctagtgacactgtttctttgtggattgaacaggatgaa

SEQ ID NO: 638 - DNA, 614 bp, Setaria italica
atccaggtatgccccgccgattctctaacgttagatccctttgcgcatcctgtcttctggtcgttacagcgatctggctgttcgttctagggttgtatttgctccaaaatgcgtgttttgctagtcttgtgacgccatattagtcggtagatttggtctcgtagaaatgggatgatggtttgcaaatgtttgtttggtggtagtttttcaggtccaaccgtcccgagtgagatggtaaatcaggcgcttagccgtcagattgtatgctgaccattaggatttacttgaatcgtttagagcatatttaatggaattattagcgtggcttacaagctgcgaagacgtggttaagatttgatgagtgctgttctagactgtacgtgtcttagattatttcaattcatgtatccaaaattttgaaattttcagcttcattattgtatgatgatggattcgtgtgttgtcaactagattgtaagctaatttgtataatcttttggttgggttttgctgatggtactctattgttacgctatcacttaatctagctccttttatgcctgaaaaaaatggactctagtgacactgtttctttgtggattgaacaggatcag

SEQ ID NO: 639 - DNA, 616 bp, Setaria italica
atccaggtatgccccgccgattctctaacgttagatccctttgcgcatcctgtcttctggtcgttacagcgatctggctgttcgttctagggttgtatttgctccaaaatgcgtgttttgctagtcttgtgacgccatattagtcggtagatttggtctcgtagaaatgggatgatggtttgcaaatgtttgtttggtggtagtttttcaggtccaaccgtcccgagtgagatggtaaatcaggcgcttagccgtcagattgtatgctgaccattaggatttacttgaatcgtttagagcatatttaatggaattattagcgtggcttacaagctgcgaagacgtggttaagatttgatgagtgctgttctagactgtacgtgtcttagattatttcaattcatgtatccaaaattttgaaattttcagcttcattattgtatgatgatggattcgtgtgttgtcaactagattgtaagctaatttgtataatcttttggttgggttttgctgatggtactctattgttacgctatcacttaatctagctccttttatgcctgaaaaaaatggactctagtgacactgtttctttgtggattgaacaggatcaggg

SEQ ID NO: 640 - DNA, 655 bp, Setaria italica
atccaggtatgccctggccgatcttctcacgttagatcccttctgtgtatggtgtcttctgatcttctgttcgttacagcgatctggctgttcgttctagggctgttattgttgctgggttggctccaaaatgcgcgttttgctagtcttgtggcgccatagtagtcagtagatttgcttctgttgaaatgggatgatggtttgcacatgtttgtttggtggtggttgttcaggtctggatgagatattaaatctttcgcttagccctcagattgtatgttaggatttgcttgaatcattttgagtatacttaatggaattattagcttagcttaatggtcgagaagacgtggttaagatttgctttgctgactacctagtgctgttgtagactgtacgtatttggggttatttcaattcatgtatccagaagtttaaaactttcagcttcattggtggcacacaaaatgttaagtgtttgtattatgatagattcatgtgttgtcaactagattgaaggctattcgtataatcttttggttgggtttttgctgaagggtgctctattgctatgcaatcacttaatctagctccttttatgcctgaaaaatggacttttagtgacactgtttctttgtggattgaacaggatgaa

SEQ ID NO: 641 - DNA, 655 bp, Setaria italica
atccaggtatgccctggccgatcctctcacgttagatcccttctgtgtatggtgtcttctgatcttctgttcgttacagcgatctggctgttcgttctagggctgttattgttgctgggttggctccaaaatgcgcgttttgctagtcttgtggcgccatagtagtcagtagatttgcttctgttgaaatgggatgatggtttgcacatgtttgtttggtggtggttgttcaggtctggatgagatattaaatctttcgcttagccctcagattgtatgttaggatttgcttgaatcattttgagtatacttaatggaattattagcttagcttaatggtcgagaagacgtggttaagatttgctttgctgactacctagtgctgttgtagactgtacgtatttggggttatttcaattcatgtatccagaagtttaaaactttcagcttcattggtggcacacaaaatgttaagtgtttgtattatgatagattcatgtgttgtcaactagattgaaggctattcgtataatcttttggttgggtttttgctgaagggtgctctattgctatgcaatcacttaatctagctccttttatgcctgaaaaatggacttttagtgacactgtttctttgtggattgaacaggatcag

SEQ ID NO: 642 - DNA, 593 bp, Setaria italica
atccaggtaatgcaccacgagcccgagccgatccaccctctcttgttaggcagttcttctagggctgctgttgttgctaggccaggctcaagatgcgtgcttgctgatgctgttgcgtcgtagtagatgttactgtggtgaaatggaaaactctagtcatcggtgtttgtgctatggttgcggttcgggtgagatgttgtttctttgcgctggattctgatactgtgaattgagcattatggtttgctagaaacgttttgaaatgtctctgaatcttcagttcctccggttcttcaatcttcggcacaaatgtatagtggcgttctgtggtaggcatttacaatgtttcactagaggtatccagggctggcctacatactcttcttttctgattatcgcaatattgttctgtggtggcactgtgccttgtagtttgaaaacgttattgttagcatatacatgcctgacttttccattcgggtagaatcatggtgctctcttaatttgattgtagcttgatttgtcgctttgtcatgtatctgaaattcctgaactaactgtgacatcgatttttcatggttgagcaggatgaa

SEQ ID NO: 643 - DNA, 593 bp, Setaria italica
atccaggtaatgcaccacgagcccgagccgatccaccctctcttgttaggcagttcttctagggctgctgttgttgctaggccaggctcaagatgcgtgcttgctgatgctgttgcgtcgtagtagatgttactgtggtgaaatggaaaactctagtcatcggtgtttgtgctatggttgcggttcgggtgagatgttgtttctttgcgctggattctgatactgtgaattgagcattatggtttgctagaaacgttttgaaatgtctctgaatcttcagttcctccggttcttcaatcttcggcacaaatgtatagtggcgttctgtggtaggcatttacaatgtttcactagaggtatccagggctggcctacatactcttcttttctgattatcgcaatattgttctgtggtggcactgtgccttgtagtttgaaaacgttattgttagcatatacatgcctgacttttccattcgggtagaatcatggtgctctcttaatttgattgtagcttgatttgtcgctttgtcatgtatctgaaattcctgaactaactgtgacatcgatttttcatggttgagcaggatcag

SEQ ID NO: 644 - DNA, 440 bp, Setaria italica
gagaaggtgtttattcctgaaatcccattttcgcatctcattcttagctaaattctgattttctgagtcatttagggaggggtattttcctgcaatcgcagttatgatttggtattagcttccatttagttaattacctcctggcgaaacacatgtttctaaaggcagaataagatagctagtggtttaacttttaagttaactatactgatatacatgcaatttgtcattgctgcatcttatatttagttcacattgacaacagactgaaactacaccactcatctgtcttgcattttagcaatctgcacctcatgacgcaaaataattttacttgctatagctgtgcttcactcatggtattcatcccttcaagacaattttttttgggaattgtgctcatttcgaattatatggttcttttcttgttccaggaagtg

SEQ ID NO: 645 - DNA, 196 bp, Setaria italica
ggactggtaaggattgcttcagcgcaatcagtcaccgcttctccgtttgtttgggcgcttcgctccgtcaaaatgccgggccgcgcgcaaccatcgttgagcaaatttcgggagttccgatttgattgttcatagatgcttgctacctacgctgagagaggcccttcgttttgttgctgcttgtggtcaggtggga

SEQ ID NO: 646 - DNA, 95 bp, Setaria italica
gcgccggtaaggtggctatcagaggccgcggggatgcgagcgctgttgactgagaggggaagcactgacaggagcttttgtttcgccagggtgtg

SEQ ID NO: 647 - DNA, 420 bp, Setaria italica
atgggggtattatatctcttctgcttcaaacttgtctttcagttcctttggttgcacccatgtgagggcgcttgctttttagttctcgtacattggttcaggttatgttcatcagtttggtgattctattctgggacaatacggccactttagctgttcttcagctgctaatattggggcctttgggcaacaattcatttactagtgtacaagaaacataatgcatcaaggctctgcgccctattgaacaattgcagtgaaatgaacagattaagcaaaaatgaacagtgaaatgttgttgtcagtgatgatgaattgcagtgaaatgttctatttatgctgtgagcctgtgaaattagcgtgtccttccaatgcttgatcgttttgtctaaattccacccatctttttaacaggcaagt

SEQ ID NO: 648 - DNA, 130 bp, Setaria italica
acgcaggtgagatctcctatctattcgattttatcctctttcggttcctgtttgtttgttgctgctaccggctttctacgtggcatgagcgactgagattgttcgtgcgcaacaatttcctcaggtcatc

SEQ ID NO: 649 - DNA, 648 bp, Setaria italica
tctgaggtgttctgatgtttcccttgctcctacccaattttttcactgaattggtcagagagttatctctgtttatgctaatccagatagggaggttgtattaagctagttcagcttacatactactctgacaagattaagttaaaagggtgcttattgatcatcacctgctttgaacttgtttttattgaataatggtagattgagagaatacaaagtcaaccaattgtcctgtccgcctgtgaacaagtgtgccaagttcagacaagtgtagcctgcattgctgttgctgccctgcaattccaagtcgtttgattgcccatagtgttactagcacctggatttgtggtgtacctgtcatttggtcctacaatgtacccaatttgtaacactgtgctaccacttctgttttcttctgaagaatgatagaagatgcacatctgtgctgacacttccttctgttttcttctgaacaatgacagaagatgcacatctgtgctgacacttccttctgttttcttctgaacaatcacacaagatgcacatctgttctgtgctgacacttccttctgttgtcttctaaagaatgacagaaaatgcacatctgtgctgactgctgacacctcctgttttcttctgaaggaagac

SEQ ID NO: 650 - DNA, 135 bp, Setaria italica
taactggtatgataagttgtaccaagttatggcatcaccttgcatgcttttttcacttttagatttgataatctttaatcagtagaaacttcatgggtgaccttctcccttgcggttgaccgtatgcaggtcccg

SEQ ID NO: 651 - DNA, 543 bp, Setaria italica
atctgtgtacgtttcacgggtctcattcccacctaatatgttttttttaacacgacttgaggggatatcgactggatttcatgtcgctgtggatgatattttggtcatatcaaatttctcgtctttgttcagtcaaatatggtcaaactggtggcgaaagcacatttcccttcttttaaaagaatacgtttcaaggaagatttgataaacagaatgaccaaattttcggtggcatactgaagaagagagagtccatcttagcacaaacaaaaaacattaataaaaaattggcactggtagtgaaatttctcaagcttgaattcatgtccggagataagttaatttatgacaggagggagtatacaggcacccagcttgtccatctgttctgctgtatctctgtacttatgaagatttttacaacttcccttacgaatttcctgaggagttgcctttggatctttatttcactaattattctgcctttatttattctccttgcttctaaacaaaacactaacacaagtaatcctgcaggactgg

SEQ ID NO: 652 - DNA, 1017 bp, Setaria italica
gaaccggtaacttgtttagttctaaaagaatgctgatgaagtgatgatgattcgtccgtattttttctagcacttttatttagcttatatgacactgaacaacctgttagttttggtggaatttaccatatgcattaatctgacgagaataaatctcttgtgtacctgagatttcttcttttttttcctttagctatattttgccccttctactctggcctcttattgaaaaaattaagacttgttgggaaaaaggaatcattttcgacagcccccagttggaacttggaagccaacttttccatgtggccaaattcctttcacgtagaacatttgtaattgatccttgttgcttagggtagttccaaaatagctgattgctaactatcttattttgaaaagctttaaatatgttcatatactgtttcgagctttagatactgcagacaggataagttcgtgccgtgggctgggagcaggggcggagccacgttgtaagttctgggtgcggccgcacccagaaaaatttcaaaatcagttatagctataaattttcattctatttggttgaacatcatacatatgttatgaagtgctacaccccctattgtttttctctagcttcgcccctggctgggagaatcgtttactcagtagagtaacatgctatgttgttatcagcataatgaaaatatgttgaataagaaattgtctctttaagcttagacatgctgcagctagttagaatgtaatatcgaactgccttgtctggaaagaaatatataacaaaagctacatgctcggttaggtggtgctaatattgcaatttgagtttgttctgcttgttaaatgagcatatacaatctttggtaacagcagttggtacttttctgtttcatgactttatagctttgtagtcaagtgtatgtgactgtttgcacacaagtttctgaaggctctgatacatgttatctgctgctgtggtctgatctttctctgtctgagatgcaggacatc

SEQ ID NO: 653 - DNA, 587 bp, Setaria italica
attcaggtacgggtgctgataaaaaactaatcttccatgtctttactgtaatagaggtcgatcagactgcggatacgcctcttccgcgggggaaatcgagtgtttcttcacttgatttgtgccgttcttggccgtcctgttagcctttccggttggatttgacgcagaggtggagagtagtgttggatcggatttttgggggaactgaagttttgggtgctcttgggaggcatgggaaagtttttttttttatgcgtggtggttggggaagtacggtgatcggctttttagttccataagaatttttcctttttatgcagaccattatctagaacatgtgggtgataaagattctagatttgctattttttttagcgtgagttggattgctagactactacgcttacaagtttttgagtagttggtgaacggtgtataacttgttcacatttgtgtagctgaactgctattgttgcagagcataaaattgttcaccttttagttctgctatagaaatggttttataactggtaaattttatggtgcttttagctgatccagttaagcttacccttttgcagaattgc

SEQ ID NO: 654 - DNA, 381 bp, Setaria italica
ttgctggtgaggactccctagctcacctggatgctcccttcggtttgttctgtggaatagtcctttgtttgctgcgagttcccaaatccgtcgttctggtatggatgcgtcgatccatctagtgtgttgcagattcatgttttgcgcggtggagtagtaatagcagtatgtattccaaattttctggtcttcagcaactgaatcgattcccctcgttaagtccgcccgtgctttagtttggaagatgttgtgattgctttgttttcccggactaattagtagggtgaagaaatatctcctttcctgttccttgtttttgttcaggcgatgtatctgttgcaagttctgtgatttgattcgagtttctgttcatagcaaaca

SEQ ID NO: 655 - DNA, 381 bp, Setaria italica
ctgctggtgaggactccctagctcacctggatgctcccttcggtttgttctgtggaatagtcctttgtttgctgcgagttcccaaatccgtcgttctggtatggatgcgtcgatccatctagtgtgttgcagattcatgttttgcgcggtggagtagtaatagcagtatgtattccaaattttctggtcttcagcaactgaatcgattcccctcgttaagtccgcccgtgctttagtttggaagatgttgtgattgctttgttttcccggactaattagtagggtgaagaaatatctcctttcctgttccttgtttttgttcaggcgatgtatctgttgcaagttctgtgatttgattcgagtttctgttcatagcaacac

SEQ ID NO: 656 - DNA, 101 bp, Setaria italica
caatgggtatgtcatttggctcatcttttttgttgaaccatgcatctacttcctgctgttccaggttctcatgctgtgctgcattcactatacagcaaggg

SEQ ID NO: 657 - DNA, 708 bp, Setaria italica
tcttcggtacgtgcctggcgcccttctcctcgtttcacttcggacttagtagaacgcttactagcattgcttaatttcttgcgtgttcgcgtagtcgatttgtctagttattcgtcggagatttccattgaatccttgcgcgtaagatgtttgtagacctattggagtttgtttttactgtagcaagcattatctgctctgttactatgggcgacacgagtagcagtaaccattgggaagtgatttgttcagtgcgaatagtagctgcttgtttatgcacactatatgagtaggattaaccattaagaagaacatatgtgtgaaatttgttgatcagaattaggtgctgcagtctatcctctgtttctaaaatttattagtactagttgcaatcagtttttttcgattggagctgtaatcagtaattaccgtcagttttcattagcatctggtgtagatgctactctagatctgcttagatggattgcgtgctattacatttttgaactaaaattttactgaaatgatgacttaccttggtaaattttcctattactgtagtaaatttcagattgcattggtggaattcgttgatctctgaaagctgaatgaagagttgatgttggttactgtagttgatgtttttctgccgtgatttgacggtcaaactgactgtgttgttgctcgtccctttggatgcagacgcga

SEQ ID NO: 658 - DNA, 708 bp, Setaria italica
acttcggtacgtgcctggcgcccttctcctcgtttcacttcggacttagtagaacgcttactagcattgcttaatttcttgcgtgttcgcgtagtcgatttgtctagttattcgtcggagatttccattgaatccttgcgcgtaagatgtttgtagacctattggagtttgtttttactgtagcaagcattatctgctctgttactatgggcgacacgagtagcagtaaccattgggaagtgatttgttcagtgcgaatagtagctgcttgtttatgcacactatatgagtaggattaaccattaagaagaacatatgtgtgaaatttgttgatcagaattaggtgctgcagtctatcctctgtttctaaaatttattagtactagttgcaatcagtttttttcgattggagctgtaatcagtaattaccgtcagttttcattagcatctggtgtagatgctactctagatctgcttagatggattgcgtgctattacatttttgaactaaaattttactgaaatgatgacttaccttggtaaattttcctattactgtagtaaatttcagattgcattggtggaattcgttgatctctgaaagctgaatgaagagttgatgttggttactgtagttgatgtttttctgccgtgatttgacggtcaaactgactgtgttgttgctcgtccctttggatgcaggcgcgg

SEQ ID NO: 659 - DNA, 1529 bp, Setaria italica
tctttggtaagcacgtcccctccattcctctgtttttttatgcaatccgcgtggtcgagtttaatctcgtggttatctacataatgtggattttgtgtggtagatccgtttgttgtgcttgatccattgctagttttttttagctaaaagcgaattgtttggtgtgtccgctatgagctgtttaagtctgcatagatctgatctggaatgcagtttcgttttctagtctgttcacatgacatatgattggatctaggaatttcgtaaatttgtctgaaaaatgtactatatttgactgtatttttaccgtggatgatgtattttcctttatcactaccttttacgtatttgtttgttcacgtgtagactgcacatttgttttttcggtttggagatattaaatcaatggtagatgtacatgtagggttgacacatccgcaaaattgtcactgctcttctctcggcaatacagaaactgctcttgatctttgatgaattgctttgtcattgatctataaaaaacatgcattttactttatgtacagtgtacaaaagagttatttttatctgtgctcgagttcccataggacacttattgccacgctattgctctctaggacttattatgattacacacacatggataatgtgtgtaacgacaactcgtgtcataatgtggcaaggtgtatcttttgtatatcgttttctaagtcgttgtatggtcataggattaactttgttttgtttaaataggccaatactttgctagctcagtgctttctgtatcagtcatagcccctaagtcatagacagtttatttggaattattcactgtgttgctgcaagttggagttattataatttttggcagcttctggacattatctagttactaataactatatagaattcagagtgcgtgtttggaactattctatattttattcatgcacggaaatgaagtatagcttaccttttctatggctatgtataagagcatgacaactttgagtgtgggttctgttatgctttattaagctcttctgggtctggataatttgtttaaagttgccaattaagtatgatcttcaattcgtcatgtatatccggtacttcaattatatagcaatctttaatgctgatgctattttagaaattaagttgcacatccaatccctattccctaagcaagtagatatgttctccatcacacaagatgttactgttaatgaaatgctcttgttatgttggtaccttacatattgttcaaactgtttgaggtattatgatatcttgcatcacctggtccactatatctttagaaattcaaaacaaatgaagtagtaatattctaatattttttttgaaccaacaccttttttttaatctctgacattatcaatagtgaaattcggtttactttatgtcttcgggtaaggctgtaggtatggatatatcagatttatgaaatgtaacattcaaatgatgattctgattatgactctttttatgaaattctgcagatgcta

SEQ ID NO: 660 - DNA, 1532 bp, Setaria italica
tctttggtaagcacgtcccctccattcctctgtttttttatgcaatccgcgtggtcgagtttaatctcgtggttatctacataatgtggattttgtgtggtagatccgtttgttgtgcttgatccattgctagttttttttagctaaaagcgaattgtttggtgtgtccgctatgagctgtttaagtctgcatagatctgatctggaatgcagtttcgttttctagtctgttcacatgacatatgattggatctaggaatttcgtaaatttgtctgaaaaatgtactatatttgactgtatttttaccgtggatgatgtattttcctttatcactaccttttacgtatttgtttgttcacgtgtagactgcacatttgttttttcggtttggagatattaaatcaatggtagatgtacatgtagggttgacacatccgcaaaattgtcactgctcttctctcggcaatacagaaactgctcttgatctttgatgaattgctttgtcattgatctataaaaaacatgcattttactttatgtacagtgtacaaaagagttatttttatctgtgcctcgagttcccataggacacttatttgccacgctattgctctctaggacttattatgattacacacacatggatatggtgtgtaacgacaaactcgtgtcataatgtggcaaggtgtatcttttgtatatcgttttctaagtcgttgtatggtcataggattaactttgttttgtttaaataggccaatactttgctagctcagtgctttctgtatcagtcatagcccctaagtcatagacagtttatttggaattattcactgtgttgctgcaagttggagttattataatttttggcagcttctggacattatctagttactaataactatatagaattcagagtgcgtgtttggaactattctatattttattcatgcacggaaatgaagtatagcttaccttttctatggctatgtataagagcatgacaactttgagtgtgggttctgttatgctttattaagctcttctgggtctggataatttgtttaaagttgccaattaagtatgatcttcaattcgtcatgtatatccggtacttcaattatatagcaatctttaatgctgatgctattttagaaattaagttgcacatccaatccctattccctaagccaagtagatatgttctccatcacacaagatgttactgttaatgaatgctcttgttatgttggtaccttacatattgttcaaactgtttgaggtattatgatatcttgcatcacctggtccactatatctttagaaattcaaaacaaatgaagtagtaatattctaatattttttttgaaccaacaccttttttttaatctctgacattatcaatagtgaaattcggtttactttatgtcttcgggtaaggctgtaggtatggatatatcagatttatgaaatgtaacattcaaatgatgattctgattatgactctttttatgaaattctgcagatgcta

SEQ ID NO: 661 - DNA, 1532 bp, Setaria italica
actctggtaagcacgtcccctccattcctctgtttttttatgcaatccgcgtggtcgagtttaatctcgtggttatctacataatgtggattttgtgtggtagatccgtttgttgtgcttgatccattgctagttttttttagctaaaagcgaattgtttggtgtgtccgctatgagctgtttaagtctgcatagatctgatctggaatgcagtttcgttttctagtctgttcacatgacatatgattggatctaggaatttcgtaaatttgtctgaaaaatgtactatatttgactgtatttttaccgtggatgatgtattttcctttatcactaccttttacgtatttgtttgttcacgtgtagactgcacatttgttttttcggtttggagatattaaatcaatggtagatgtacatgtagggttgacacatccgcaaaattgtcactgctcttctctcggcaatacagaaactgctcttgatctttgatgaattgctttgtcattgatctataaaaaacatgcattttactttatgtacagtgtacaaaagagttatttttatctgtgcctcgagttcccataggacacttatttgccacgctattgctctctaggacttattatgattacacacacatggatatggtgtgtaacgacaaactcgtgtcataatgtggcaaggtgtatcttttgtatatcgttttctaagtcgttgtatggtcataggattaactttgttttgtttaaataggccaatactttgctagctcagtgctttctgtatcagtcatagcccctaagtcatagacagtttatttggaattattcactgtgttgctgcaagttggagttattataatttttggcagcttctggacattatctagttactaataactatatagaattcagagtgcgtgtttggaactattctatattttattcatgcacggaaatgaagtatagcttaccttttctatggctatgtataagagcatgacaactttgagtgtgggttctgttatgctttattaagctcttctgggtctggataatttgtttaaagttgccaattaagtatgatcttcaattcgtcatgtatatccggtacttcaattatatagcaatctttaatgctgatgctattttagaaattaagttgcacatccaatccctattccctaagccaagtagatatgttctccatcacacaagatgttactgttaatgaatgctcttgttatgttggtaccttacatattgttcaaactgtttgaggtattatgatatcttgcatcacctggtccactatatctttagaaattcaaaacaaatgaagtagtaatattctaatattttttttgaaccaacaccttttttttaatctctgacattatcaatagtgaaattcggtttactttatgtcttcgggtaaggctgtaggtatggatatatcagatttatgaaatgtaacattcaaatgatgattctgattatgactctttttatgaaattctgcaggtgctc

SEQ ID NO: 662 - DNA, 1806 bp, Setaria italica
tctttggtgagcacctcctcgatccccctcgctacttgctcttcgtcagatctgttttgtttggcgcgacttgtacttcgatctggtcgatctgtcgctgctttggctggatctgtgttagtgctaggtttgtttatgctgttggtcagatccaatatagtttttgcttggatctagcatagttccttttgacttagatccgttactagttgtattaagtttgtgttggtatcgagatccgtagtctgtagcacctagtcgtgtgtggccagatgccataattttttatagtacctgacatcaacacttcaatctgttgttacagtagatcttgtgaaatttgtttgtcctatgctgctcttatgttagatctgttaatacttaaagggctatgccatatcctatcttaagcgaagtttaaaccacgtagcctgatactttgttaaagcatttgtttttgtctgttatgcttgcttccttgatataagctgacagttatcagtgcatcattattagattatttcttgtctgaatgatttgtcccccacctattgtgttgactcggatttgttgcatttcggtgattatgtagacgatttgttataaaagcatttgatcagttgtttaaagagtagcatattttatttgtcaactcttgagctggcagattaatgatgaaacaattaccccaagcgctttattccactgatttcagtgtgatggaaagctatgttatcatagcttttgtggttttcaatctgaaacatctgcagttcaagcattacttaacttttcagtttttttcctttgatgttatgctagtatttttttgcttcttcctcttgtgtcaaacaaaattaagtttattagaataatgtttggaatctcttgggttcagtaatgagagaagtgatgagatcatatccacacgagatatctgcattcattatgatgatcactatcatgcactaccatctgatctctcatcactgttttaattttttgttttcattagaaacttttgattccctagtttctttgaatattgaccagtaaatttaaagggtattcatcttatgtggtttgcaacaccacatttcctaataagttctctgttttaaatgttcttgtgagtctgacattcatctcaaagtttactaggatagtagtcacacattgctgttcaatcttaatggggaaatgatgataccatatccacacgagatatctgcagtcattatgatgatcacatcatgcactaccatctgatatccttgtttgtccatattacttccattattatttttttaatacttgagttgaaaagtttcatttttatgtgcaatctgtgatgcaactattcccattacatgaatcactgtgattattatgaaaaaaatcaccatctttcggctgagattgcacaacctaagttacattttcttaaattacatactatttgtttctttacattttgcaatcaaatgccatttggtatctgatgcacagtctttttgggctgtgtgtctcgaaaacgtggcaaaaaaactaggggaacgggatcttgcgacactggtcactcattttatgagcttccagttactatatgcccgttttacattaatactagtattatgatatctttggtcagatctttgcaatatgttgttgtagtgttgactgcaaaactgatgtgcatacatttgattagttaggttcagttatgtacacagtgatttatttgtatgcttatgtagcatttgaaatgttgcaatctctgacaaaattgttctcatgcagatgcca

SEQ ID NO: 663 - DNA, 899 bp, Setaria italica
tcttcggtacgtgctcgctgctccgactcctccagcttttgttggtgctgcgtttctgtgaatgcttacggcctctaggatacgtgactggtttagttagatttagattaacctctgaaattcgattcgtaaatctccgtgctgattataccgtgttctctagatagatgctaacgtaataacagtaggaatcaatgatagaaccttcccagaattatgtttgtgatagaacatacaatttgtttctaaaataacagagagagacatacaatttagtgcttaaatttagattcagaaattttctgtaaaatacattttgggtgcttagtggtatgtttaacatctgctaattttagatttagagttctgttaaatttagcagcagggattcatagtccaggttaattgtatagtcgtttggtccgtcgagcttattttgtgacgaaattagataaataaacaactccttgctgtaatggtctcctgttattgcttgaagaaataaataactgagagcatttcaacgcattgctctgctcgttttttgttgtgaatttgtttgttgcctgaagaaataaataattaagtgatggattgctctgctcatttattgggacaacgtctattaagcagagcaacttgttgtaattttttgttgctgtgctttgtctgctgtcaatgaaacagggttaactgatagtctgacaggttacatatgcttgttgtgacatgttgcaagcctttagatctctgtttgctgtaattctgaagttgaattgagtggcactctgttctgtgtaattccgaataagttgaattgattggaagagatctccttcttcctgataatgaatactgtgaactcacaatcttgttcgttctttatattgcagatgcaa

SEQ ID NO: 664 - DNA, 899 bp, Setaria italica
acttcggtacgtgctcgctgctccgactcctccagcttttgttggtgctgcgtttctgtgaatgcttacggcctctaggatacgtgactggtttagttagatttagattaacctctgaaattcgattcgtaaatctccgtgctgattataccgtgttctctagatagatgctaacgtaataacagtaggaatcaatgatagaaccttcccagaattatgtttgtgatagaacatacaatttgtttctaaaataacagagagagacatacaatttagtgcttaaatttagattcagaaattttctgtaaaatacattttgggtgcttagtggtatgtttaacatctgctaattttagatttagagttctgttaaatttagcagcagggattcatagtccaggttaattgtatagtcgtttggtccgtcgagcttattttgtgacgaaattagataaataaacaactccttgctgtaatggtctcctgttattgcttgaagaaataaataactgagagcatttcaacgcattgctctgctcgttttttgttgtgaatttgtttgttgcctgaagaaataaataattaagtgatggattgctctgctcatttattgggacaacgtctattaagcagagcaacttgttgtaattttttgttgctgtgctttgtctgctgtcaatgaaacagggttaactgatagtctgacaggttacatatgcttgttgtgacatgttgcaagcctttagatctctgtttgctgtaattctgaagttgaattgagtggcactctgttctgtgtaattccgaataagttgaattgattggaagagatctccttcttcctgataatgaatactgtgaactcacaatcttgttcgttctttatattgcaggtgcac

SEQ ID NO: 665 - DNA, 144 bp, Setaria italica
tcttcggtaagtacagcgccatcgatctatcttgttgagttgttaggcgtacgtgttttttttatcttgtttgttcgatccgttcaaattgacgtggggtgcgggatctcagactttgcgtggttcgatctgttgcagatgcca

SEQ ID NO: 666 - DNA, 144 bp, Setaria italica
acttcggtaagtacagcgccatcgatctatcttgttgagttgttaggcgtacgtgttttttttatcttgtttgttcgatccgttcaaattgacgtggggtgcgggatctcagactttgcgtggttcgatctgttgcaggtgccg

SEQ ID NO: 667 - DNA, 357 bp, Setaria italica
tctttggtaagtcttcctcttccgcgcctttttgggaataattctagtttcgtggttgtggtgtcaaaacgaactagttatatgatgatgatcggtgaccataatgaataagtcagaacaaatctgctgtatcactcagttatcacaattgcacggctccatgctctgctcccactactctgttttttttgctggcagagcagcgctaaattttttatctctagtaaaaaactagatgcaccttttcacaatagtgaaatttgttagcacagaataggagtatttataacacagaaaattgtgattatccactgcgactagtctcttaaccactctgcttctgccatgcagacgcca

SEQ ID NO: 668 - DNA, 357 bp, Setaria italica
actctggtaagtcttcctcttccgcgcctttttgggaataattctagtttcgtggttgtggtgtcaaaacgaactagttatatgatgatgatcggtgaccataatgaataagtcagaacaaatctgctgtatcactcagttatcacaattgcacggctccatgctctgctcccactactctgttttttttgctggcagagcagcgctaaattttttatctctagtaaaaaactagatgcaccttttcacaatagtgaaatttgttagcacagaataggagtatttataacacagaaaattgtgattatccactgcgactagtctcttaaccactctgcttctgccatgcaggcgccg

SEQ ID NO: 669 - DNA, 345 bp, Setaria italica
gtaagtcttcctcttccgcgcctttttgggaataattctagtttcgtggttgtggtgtcaaaacgaactagttatatgatgatgatcggtgaccataatgaataagtcagaacaaatctgctgtatcactcagttatcacaattgcacggctccatgctctgctcccactactctgttttttttgctggcagagcagcgctaaattttttatctctagtaaaaaactagatgcaccttttcacaatagtgaaatttgttagcacagaataggagtatttataacacagaaaattgtgattatccactgcgactagtctcttaaccactctgcttctgccatgcag

SEQ ID NO: 670 - DNA, 1804 bp, Setaria italica
tctttggtgagcacctcctcgatccccctcgctacttgctcttcgtcagatctgttttgtttggcgcgacttgtacttcgatctggtcgatctgtcgctgctttggctggatctgtgttagtgctaggtttgtttatgctgttggtcagatccaatatagtttttgcttggatctagcatagttccttttgacttagatccgttactagttgtattaagtttgtgttggtatcgagatccgtagtctgtagcacctagtcgtgtgtggccagatgccataattttttatagtacctgacatcaacacttcaatctgttgttacagtagatcttgtgaaatttgtttgtcctatgctgctcttatgttagatctgttaatacttaaagggctatgccatatcctatcttaagcgaagtttaaaccacgtagcctgatactttgttaaagcatttgtttttgtctgttatgcttgcttccttgatataagctgacagttatcagtgcatcattattagattatttcttgtctgaatgatttgtccccccacctattgtgttgactcggattttgttgcatttcggtgatttatgtagacgatttgttataaaagcatttgatcagttgtttaaagagtagcatattttatttgtcaactcttgagctggcagattaatgatgaaacaattaccccaagcgctttattccactgatttcagtgtgatggaaagctatgttatcatagcttttgtggttttcaatctgaaacatctgcagttcaagcattacttaacttttcagtttttttcctttgatgttatgctagtatttttttgcttcttcctcttgtgtcaaacaaaattaagtttattagaataatgtttggaatctcttgggttcagtaatgagagaagtgatgagatcatatccacacgagatatctgcattcattatgatgatcactatcatgcactaccatctgatctctcatcactgttttaattttttgttttcattagaaacttttgattccctagtttctttgaatattgaccagtaaatttaaagggtattcatcttatgtggtttgcaacaccacatttcctaataagttctctgttttaaatgttcttgtgagtctgacattcatctcaaagtttactaggatagtagtcacacattgctgttcaatcttaatggggaaatgatgataccatatccacacgagatatctgcagtcattatgatgatcacatcatgcactaccatctgatatccttgtttgtccatattacttccattattatttttttaatacttgagttgaaaagtttcatttttatgtgcaatctgtgatgcaactattcccattacatgaatcactgtgattattatgaaaaaaatcaccatctttcggctgagattgcacaacctaagttacattttcttaaattacatactatttgtttctttacattttgcaatcaatgccatttggtatctgatgcacagtcttttttggctgtgtgtctcgaaacgtggcaaaaaactagggggaacggatcttgcgacactggtcactcatttatgagcttccagttactatatgcccgtttacattaatactagtattatgatatctttggtcagatctttgcaatatgttgttgtagtgttgactgcaaaactgatgtgcatacatttgattagttaggttcagttatgtacacagtgatttatttgtatgcttatgtagcatttgaaatgttgcaatctctgacaaaattgttctcatgcagatgcca

SEQ ID NO: 671 - DNA, 1801 bp, Setaria italica
tctttggtgagcacctcctcgatccccctcgctacttgctcttcgtcagatctgttttgtttggcgcgacttgtacttcgatctggtcgatctgtcgctgctttggctggatctgtgttagtgctaggtttgtttatgctgttggtcagatccaatatagtttttgcttggatctagcatagttccttttgacttagatccgttactagttgtattaagtttgtgttggtatcgagatccgtagtctgtagcacctagtcgtgtgtggccagatgccataattttttatagtacctgacatcaacacttcaatctgttgttacagtagatcttgtgaaatttgtttgtcctatgctgctcttatgttagatctgttaatacttaaagggctatgccatatcctatcttaagcgaagtttaaaccacgtagcctgatactttgttaaagcatttgtttttgtctgttatgcttgcttccttgatataagctgacagttatcagtgcatcattattagattatttcttgtctgaatgatttgtcccccacctattgtgttgactcggatttgttgcatttcggtgattatgtagacgatttgttataaaagcatttgatcagttgtttaaagagtagcatattttatttgtcaactcttgagctggcagattaatgatgaaacaattaccccaagcgctttattccactgatttcagtgtgatggaaagctatgttatcatagcttttgtggttttcaatctgaaacatctgcagttcaagcattacttaacttttcagtttttttcctttgatgttatgctagtatttttttgcttcttcctcttgtgtcaaacaaaattaagtttattagaataatgtttggaatctcttgggttcagtaatgagagaagtgatgagatcatatccacacgagatatctgcattcattatgatgatcactatcatgcactaccatctgatctctcatcactgttttaattttttgttttcattagaaacttttgattccctagtttctttgaatattgaccagtaaatttaaagggtattcatcttatgtggtttgcaacaccacatttcctaataagttctctgttttaaatgttcttgtgagtctgacattcatctcaaagtttactaggatagtagtcacacattgctgttcaatcttaatggggaaatgatgataccatatccacacgagatatctgcagtcattatgatgatcacatcatgcactaccatctgatatccttgtttgtccatattacttccattattatttttttaatacttgagttgaaaagtttcatttttatgtgcaatctgtgatgcaactattcccattacatgaatcactgtgattattatgaaaaaaatcaccatctttcggctgagattgcacaacctaagttacattttcttaaattacatactatttgtttctttacattttgcaatcaatgccatttggtatctgatgcacagtcttttttggctgtgtgtctcgaaacgtggcaaaaaactagggggaacggatcttgcgacactggtcactcatttatgagcttccagttactatatgcccgtttacattaatactagtattatgatatctttggtcagatctttgcaatatgttgttgtagtgttgactgcaaaactgatgtgcatacatttgattagttaggttcagttatgtacacagtgatttatttgtatgcttatgtagcatttgaaatgttgcaatctctgacaaaattgttctcatgcagatgcca

SEQ ID NO: 672 - DNA, 1801 bp, Setaria italica
actctggtgagcacctcctcgatccccctcgctacttgctcttcgtcagatctgttttgtttggcgcgacttgtacttcgatctggtcgatctgtcgctgctttggctggatctgtgttagtgctaggtttgtttatgctgttggtcagatccaatatagtttttgcttggatctagcatagttccttttgacttagatccgttactagttgtattaagtttgtgttggtatcgagatccgtagtctgtagcacctagtcgtgtgtggccagatgccataattttttatagtacctgacatcaacacttcaatctgttgttacagtagatcttgtgaaatttgtttgtcctatgctgctcttatgttagatctgttaatacttaaagggctatgccatatcctatcttaagcgaagtttaaaccacgtagcctgatactttgttaaagcatttgtttttgtctgttatgcttgcttccttgatataagctgacagttatcagtgcatcattattagattatttcttgtctgaatgatttgtcccccacctattgtgttgactcggatttgttgcatttcggtgattatgtagacgatttgttataaaagcatttgatcagttgtttaaagagtagcatattttatttgtcaactcttgagctggcagattaatgatgaaacaattaccccaagcgctttattccactgatttcagtgtgatggaaagctatgttatcatagcttttgtggttttcaatctgaaacatctgcagttcaagcattacttaacttttcagtttttttcctttgatgttatgctagtatttttttgcttcttcctcttgtgtcaaacaaaattaagtttattagaataatgtttggaatctcttgggttcagtaatgagagaagtgatgagatcatatccacacgagatatctgcattcattatgatgatcactatcatgcactaccatctgatctctcatcactgttttaattttttgttttcattagaaacttttgattccctagtttctttgaatattgaccagtaaatttaaagggtattcatcttatgtggtttgcaacaccacatttcctaataagttctctgttttaaatgttcttgtgagtctgacattcatctcaaagtttactaggatagtagtcacacattgctgttcaatcttaatggggaaatgatgataccatatccacacgagatatctgcagtcattatgatgatcacatcatgcactaccatctgatatccttgtttgtccatattacttccattattatttttttaatacttgagttgaaaagtttcatttttatgtgcaatctgtgatgcaactattcccattacatgaatcactgtgattattatgaaaaaaatcaccatctttcggctgagattgcacaacctaagttacattttcttaaattacatactatttgtttctttacattttgcaatcaatgccatttggtatctgatgcacagtcttttttggctgtgtgtctcgaaacgtggcaaaaaactagggggaacggatcttgcgacactggtcactcatttatgagcttccagttactatatgcccgtttacattaatactagtattatgatatctttggtcagatctttgcaatatgttgttgtagtgttgactgcaaaactgatgtgcatacatttgattagttaggttcagttatgtacacagtgatttatttgtatgcttatgtagcatttgaaatgttgcaatctctgacaaaattgttctcatgcaggtgccg

SEQ ID NO: 673 - DNA, 1052 bp, Setaria italica
  misc_feature (606)..(666): n= a, c, g or t; r= g or a; w= a or t.
  unsure (1)..(1052): unsure at all n locations
ctcgaggtgagtctactgtctacatatccatcatcccggttagcttttgcgatcgaggatcctgatcctgtgcacatccttcctgctcaggaggtataacgctaccagttttaggtgcttctctttagatgcatggtatttccgttgatttgttcctgggtcttatttctccgtgtcccacttggatgtttgcccgtgttctacatgggctcgctagtagttatgcgagttcactatcgcctagtcctgctatgttggctactttgctattagatttcagttctgctatactagtgcgagggcctgtcgttacatcttatttaaaacagtgaatccatggtgttccatcttgcacacaggactcgaattatttggcacaattaattcgatatttgatagatgttcatgagtctccacaattgaccattttttgtttatctatgctgttataatatgttgatgtacactatatctgttgataaagcccacttagctcagaggttagagcatcgcatttgtaatgcgagggtcatcggttcaaatccgatagtcggcttttttttccctattcatgttccctaaacagaatttctcttcttctctgargtaaattgggaatacagggtctgttatgtcattagaccttacaattttgctggatncaawtcataaaagtatatacaaaatatttggaagttgatgaaattacatttttggtgatacttttagtagattttactctgtatcctttggtttgattcagttagttttgatgtattctgtaatgtaaattgaatgcaatttattgtgtaaaatgaaattcaataaaacaaaaagcatgtcctgttaactgttatcgagggccttgtttaattagggcatcagtgtagaggtagatgtagttaatgaacagtagtatctcctctcttggatggtgacctctgcttggtctacttgactggatatgtggtctgttcactgatttatattttgatattttgaatcttaaaactgcatgttaatatttttgaatcttaaaactgcaggttaag

SEQ ID NO: 674 - DNA, 1053 bp, Setaria italica
ctcgaggtgagtctactgtctacatatccatcatcccggttagcttttgcgatcgaggatcctgatcctgtgcacatccttcctgctcaggaggtataacgctaccagttttaggtgcttctctttagatgcatggtatttccgttgatttgttcctgggtcttatttctccgtgtcccacttggatgtttgcccgtgttctacatgggctcgctagtagttatgcgagttcactatcgcctagtcctgctatgttggctactttgctattagatttcagttctgctatactagtgcgagggcctgtcgttacatcttatttaaaacagtgaatccatggtgttccatcttgcacacaggactcgaattatttggcacaattaattcgatatttgatagatgttcatgagtctccacaattgaccattttttgtttatctatgctgttataatatgttgatgtacactatatctgttgataaagcccacttagctcagaggttagagcatcgcatttgtaatgcgagggtcatcggttcaaatccgatagtcggcttttttttccctattcatgttccctaaacaagaatttctcttcttctctgaggtaaattgggaatacagggtctgttatgtcattagaccttacaattttgctggatacaaatcataaaagtatatacaaaatatttggaagttgatgaaattacatttttggtgatacttttagtagattttactctgtatcctttggtttgattcagttagttttgatgtattctgtaatgtaaattgaatgcaatttattgtgtaaaatgaaattcaataaaacaaaaagcatgtcctgttaactgttatcgagggccttgtttaattagggcatcagtgtagaggtagatgtagttaatgaacagtagtatctcctctcttggatggtgacctctgcttggtctacttgactggatatgtggtctgttcactgatttatattttgatattttgaatcttaaaactgcatgttaatatttttgaatcttaaaactgcaggttaag

SEQ ID NO: 675 - DNA, 91 bp, Setaria italica
ccagaggtaactcatgatccatcgctcaatctgttatcatgttgttcatgcctctgctgatcggtgtcaacggctcctatgttagattttg

SEQ ID NO: 676 - DNA, 91 bp, Setaria italica
ccagaggtaactcatgatccatcgctcaatctgttatcatgttgttcatgcctctgctgatcggtgtcaacggctcctatgttaggttctg

SEQ ID NO: 677 - DNA, 554 bp, Setaria italica
cctcaggtaccgtttcttctcggctgctcctcgcttgatctatgctacttcatgctttcgcgactagattcgatgttgtattgtgccgcatcctcgtgctagtagtgatttggtcctctgatagtgattgcgttgttggtactcgcatgtccatttccctagggtttgtgggttatacgtgctcgctcggttctaggatttgactcttatggatggattcatctggatccggataattacatagattctgtaggttgatttgttagtcgtagttctggatcgaatgtttgtaggttagggttgctgcagttcctttattttgagaggcttttgctgtgtagttgatttgctgtgtagttgatgtatatgttaatagttgcagcgtctttgtttgatctattttctgatctgatctgtggaattgttctgtcactgcttttcatcattttgtttacactcctagcttgttagctggcctttaaattctgcgcagatacttgcttgtttgctctggttactgtttctaacaactgatttatctgatgcagcggttt

SEQ ID NO: 678 - DNA, 554 bp, Setaria italica
cctcaggtaccgtttcttctcggctgctcctcgcttgatctatgctacttcatgctttcgcgactagattcgatgttgtattgtgccgcatcctcgtgctagtagtgatttggtcctctgatagtgattgcgttgttggtactcgcatgtccatttccctagggtttgtgggttatacgtgctcgctcggttctaggatttgactcttatggatggattcatctggatccggataattacatagattctgtaggttgatttgttagtcgtagttctggatcgaatgtttgtaggttagggttgctgcagttcctttattttgagaggcttttgctgtgtagttgatttgctgtgtagttgatgtatatgttaatagttgcagcgtctttgtttgatctattttctgatctgatctgtggaattgttctgtcactgcttttcatcattttgtttacactcctagcttgttagctggcctttaaattctgcgcagatacttgcttgtttgctctggttactgtttctaacaactgatttatctgatgcagggttcg

SEQ ID NO: 679 - DNA, 484 bp, Setaria italica
cctcaggtaccgtttcttctcggccgctcctcgcttgatctgagctacttggtgcttctccgctgctcctcgcttgatctgtgctacttggtgctgtcgcggctggattgatgttctattgtgtcgcctcgcgcgagtagtgatttggtagtgattgagttgttgatgctcgcatctccgattccgtagggttcgtgggttttgcgtgctcgctggttaattatactactggatcgaacgtttagaggctagggctgctttaattcctttatttttgagagtctgctgctctgtagttgatgtatatactgatagttagtagcgtccttgcttgatctgttttccgatctgatctgtaaaattgttctcttactgcttttttatgtttttatatattagcaccttccttcaaattctgtgcagatacttgctcatttgccctgcttagtttttctaacaactgattcatctgatgaagcagttt

SEQ ID NO: 680 - DNA, 484 bp, Setaria italica
cctcaggtaccgtttcttctcggccgctcctcgcttgatctgagctacttggtgcttctccgctgctcctcgcttgatctgtgctacttggtgctgtcgcggctggattgatgttctattgtgtcgcctcgcgcgagtagtgatttggtagtgattgagttgttgatgctcgcatctccgattccgtagggttcgtgggttttgcgtgctcgctggttaattatactactggatcgaacgtttagaggctagggctgctttaattcctttatttttgagagtctgctgctctgtagttgatgtatatactgatagttagtagcgtccttgcttgatctgttttccgatctgatctgtaaaattgttctcttactgcttttttatgtttttatatattagcaccttccttcaaattctgtgcagatacttgctcatttgccctgcttagtttttctaacaactgattcatctgatgaaggagttc

SEQ ID NO: 681 - DNA, 373 bp, Setaria italica
cctcaggtttgtctcctcctcgtgctagtggtttggttgttcatactcgcttgcttcgaggatgtgattcttatggatggtttcatcggcattcagataattatttagattctataggttgatttgttaattgtgcttgtggatcgaatgtttagatgttggggctgttgtaattcctttgctttttgagttcgctgctatacagtaatatttttatttgacctagtttccgatctgatctgtaaattggtttgctactgcctttccaattgtttatgtattactggatttcaaattctgtgcagatgcgtgctctttttccatacttagtgtttctaacgattgactcatctgacatctgatgcagcggttt

SEQ ID NO: 682 - DNA, 373 bp, Setaria italica
cctcaggtttgtctcctcctcgtgctagtggtttggttgttcatactcgcttgcttcgaggatgtgattcttatggatggtttcatcggcattcagataattatttagattctataggttgatttgttaattgtgcttgtggatcgaatgtttagatgttggggctgttgtaattcctttgctttttgagttcgctgctatacagtaatatttttatttgacctagtttccgatctgatctgtaaattggtttgctactgcctttccaattgtttatgtattactggatttcaaattctgtgcagatgcgtgctctttttccatacttagtgtttctaacgattgactcatctgacatctgatgcagggttgc

SEQ ID NO: 683 - DNA, 521 bp, Setaria italica
cctcaggtacggtttcttctccgatgctcctcgcttgatctatggtacttggtgctgtcgcgactggatcgattttgtactctgtctcctcctcgtgctagtagggatctggccctctggtagtgattgcgttgttgatactcgcatctccgtttccgaagggtttgtgggttctgcgtgctcgcttgattctaggatttaactaattatggatgtattcatctggatccggataattcaattgatactgtaggttgatttgttaattgtactagtggatcgatgtttagaggttactgctgttgtaattcctttatctttgagaggcttttgctgtttagttgatgcatatgctaatagtttgcagcgtccttgtttgatctattttctgatatgatctgtagaattgttctgttactgcctttcatttttatattattactggccttcaagtactgcacagatacttgcccgtttgctctgtttagtgttcctaacttattcatctgatgcagcagttt

SEQ ID NO: 684 - DNA, 521 bp, Setaria italica
cctcaggtacggtttcttctccgatgctcctcgcttgatctatggtacttggtgctgtcgcgactggatcgattttgtactctgtctcctcctcgtgctagtagggatctggccctctggtagtgattgcgttgttgatactcgcatctccgtttccgaagggtttgtgggttctgcgtgctcgcttgattctaggatttaactaattatggatgtattcatctggatccggataattcaattgatactgtaggttgatttgttaattgtactagtggatcgatgtttagaggttactgctgttgtaattcctttatctttgagaggcttttgctgtttagttgatgcatatgctaatagtttgcagcgtccttgtttgatctattttctgatatgatctgtagaattgttctgttactgcctttcatttttatattattactggccttcaagtactgcacagatacttgcccgtttgctctgtttagtgttcctaacttattcatctgatgcaggagttc

SEQ ID NO: 685 - DNA, 621 bp, Setaria italica
ccgcgggtttgtgcctcctcgtgctagtagcaatttgacctttctggtagtttgatttgtttcttggtactcgcatctccgattccgtaggatttttgggttttgcgtgctaacttgcttcgaggattcgagtctcatgcatggtctcatctagatccggataatttcttagattctgtacgttgatttgttcattgtccttgtagatcgaatgcttagaggtggctgctgctttatagtcgatgcatatagtaatagtattgtttgatctagtttccgatctgaactgtaaaattgttttgttcctgcctttctaagtgtttatgtacttctggattttaaattctgcttagatatttgctcgtttgctctgtttagtgtttgtcacaattgattcatttattttcttttagaggctgcttctgtgtatccggttgtatagtttatgtttatatagttgcaacatccttgtttgatctagttcctgatctggtctgtaaattgttttgttactgccttgtaaaagtttttataatactggccttccgatttcagtgctgatacttgcttggttgctctgttttgtgtttctaacaattgactcatctgatgcagcggttt

SEQ ID NO: 686 - DNA, 620 bp, Setaria italica
ccgcgggtttgtgcctcctcgtgctagtagcaatttgacctttctggtagtttgatttgtttcttggtactcgcatctccgattccgtaggatttttgggttttgcgtgctaacttgcttcgaggattcgagtctcatgcatggtctcatctagatccggataatttcttagattctgtacgttgatttgttcattgtccttgtagatcgaatgcttagaggtggctgctgctttatagtcgatgcatatagtaatagtattgtttgatctagtttccgatctgaactgtaaaattgttttgttcctgcctttctaagtgtttatgtacttctggattttaaattctgcttagatatttgctcgtttgctctgtttagtgtttgtcacaattgattcatttattttcttttagaggctgcttctgtgtatccggttgtatagtttatgtttatatagttgcaacatccttgtttgatctagttcctgatctggtctgtaaattgttttgttactgccttgtaaaagtttttataatactggcttccgatttcagtgctgatacttgcttggttgctctgttttgtgtttctaacaattgactcatctgatgcagcggttt

SEQ ID NO: 687 - DNA, 620 bp, Setaria italica
ccgcgggtttgtgcctcctcgtgctagtagcaatttgacctttctggtagtttgatttgtttcttggtactcgcatctccgattccgtaggatttttgggttttgcgtgctaacttgcttcgaggattcgagtctcatgcatggtctcatctagatccggataatttcttagattctgtacgttgatttgttcattgtccttgtagatcgaatgcttagaggtggctgctgctttatagtcgatgcatatagtaatagtattgtttgatctagtttccgatctgaactgtaaaattgttttgttcctgcctttctaagtgtttatgtacttctggattttaaattctgcttagatatttgctcgtttgctctgtttagtgtttgtcacaattgattcatttattttcttttagaggctgcttctgtgtatccggttgtatagtttatgtttatatagttgcaacatccttgtttgatctagttcctgatctggtctgtaaattgttttgttactgccttgtaaaagtttttataatactggcttccgatttcagtgctgatacttgcttggttgctctgttttgtgtttctaacaattgactcatctgatgcagggttgc

SEQ ID NO: 688 - DNA, 126 bp, Setaria italica
gcagcggtaagtttcacgtcttagcaaaaaattcgaggaacttttgcgatgtcttcttgcgttatttgcgttttttatgctactgattttttttatcattggttttcttgtgttgtgcagatctga

SEQ ID NO: 689 - DNA, 1190 bp, Setaria italica
gcgctcgtgagttccttcgcgcttccacctctgggttttgttcctgctgtttcagaagtggctctgtggttcatcgcgcatcggactgcctgtgcggatcctatggtggccgcggctgttgggctgatggggttttgatgcttgaggattcatgccatgtagttagcttgatgtacgcgggtcacttgggtgtggaaactgtagatgcgaacggggtgtggtaggctgcctagatcctcgactctgctttcggtcaggcgtgtcttcagtgaaacatcaccgatcccctggttcgtttcaacttcaacagcacaaaaaacttcggccttcagaaagtgcagcgataggtcatttgtccgcttcgcttctttacaaccgggggttaggggggtgatgccttagtgctaatgatgtgattcagagtcgctgacctactagtagaatggttgggtgtgcatttgtatagggcctttgacctttgatccagggtgatcatgatattttggtaggggtgtatacccgtttatgtgcaactcaagtagaataatgtatttgaaccattggattcaattaggagctaatatctggtcatcccaacccaagtcattttaagctttctggtccttagttgtaattgagttgtaagttttgaggaattgttgcacacatagcagtctcttttgggtgaccttgaaaggaaaataagggtgttttagagtgtttatcatgatgcagctcagctacagtgcgtaggaggaattgaagttgagaggtgaagcatgaattgtggtttattttgataatttcgcagttaggcaattcaaaacaagtactgtttgctattctagtcccacctgcacattcctttacctagttgtatttctaaaccatcttgattggcttaatttgcatgataaatgctcctatgtcttgttgggaaacagagatttcactgaccatttccgagtataaacacacaatctgggcaattggtgtctttgcttgtgtatttttccctactatagtgaaacacatctgtcaagtggataatgtttatgttctggttcttcacttagataatggtctagatgtcattacttggcttgcatgtgtaccattaaattaacattcacagaggacttccaatttttaactctatgtctaatataattttcgttgcataggtattg

SEQ ID NO: 690 - DNA, 3284 bp, Setaria italica
gcgcttgtaagtgtttctacgtttgagccttttttgtgcactacctggtatctttgggtgcttagatttgatgtgctagatgcgtttaattagctaacttggattagcgaggttgttagcttgtagtttggacttggtgtggtgtggcaagttattttcttgtaaattaattacgttcatgggcttctgtgggctgtagaagctacagcaaggattttttttttatctgtctcgagttcagataaaatttgggcgcaaaattatcccactttgcatgctttccttctcgcagaggatgggggtgctcccatttgaatgttagagattgaattcatttgcatccttgttgtagttaggaaaatgatgattgcctgtagaatggcttgtcttatacaaaccatgcatgagcttattgacttggggacttagacatctttcattacattcttattgagatggtatgataagattggtgttgtcatgtactccctccgttccaaattataggtcgtttggacttttttagattcatatattttgctatgcacttagatatacactacgtgtatatgcatagcacaagctatgtatctagaaaagctaaaacaaactataatttgggacagaggaagtagcaaacacctcccagcagttctttgatgtactaaatttgtgtactgcctagctattaattgaagacttgtggtcaattctttcccaattcgtttaaggattccacatatctccagctgtgatttgcatagtggttttctttcaacatgatttggtgtattgatttgctgcatgctaattaattagaaatttttcagacagaaggcatagctgcctttaagctgagctgagaaattgtatcttggatattattttactgccctcgatggtttccaccaatcagagcgcctttgtcaggggaagaaatatccatgacaacttcctgtttgtccaacaaatggtgaaatccttgcacatgaagagagaggctcatattctcctcaagctggatatttctaaagcattcgactcggtttcatggtcctttctcctggaggttatgaggcagttgggttttggacagagatggcgggacatgttatgtctaatcttgtcgacctcgtccactcgtgtgttagtgaatggggagccaggggaatctattcttcatagccgaggtcttcgttagggtgatccactctctcccatgctcttcatactggtcatggacgtcctaaattctctcatggagtacgcggctagagagagattgcttcagccacttgctgttcagcaagctcggcatcgggtctccttttttgctgatgatgctgtgattttcctaaggcccgggaggactgatctgcaagtaatcagaagcatccttgacctgtttggacacacttccggcctccacactaatctggtgaaaagttctgtttctcccatacactgttcagaggaagagatgcttatcactgctgaagtcttgtcgtgtgctgtaaaggaactcccatgcatgtatcttggtttgcctctttctattcataagcccaccagagaagtgctcttgcctttgattgacaaagtagctgatcatttgcctgggtggaaagcatccctgatgaacagagcaggtcggttggtaatggttaggatggttttatccgccactcccatttattccttgatagctcttgatttgccaaattgggtgtttaaaaccatggataaaaggaggagaggtttcttttggaaaggtcaggacaagccaatgttggtaactgcctagggtcctgggaaagagttcagcggccccgggaaaatggagggatggggaattcataatcctggaactctttggttgggcattggcgtattcgaatgttgggaattcagaaaactgaattcctttccggccttgggctggattccaaattcaagcttcctcattatgccccagcctgtttaaggtagcagtcgaccatattggtggcaaatggtgttttcactcttttctggaaaagataggtggggtaattggtcacactatcgaggagttggctcccaacctgttcaaggccatccccaaaagggcaattagaagacagacagtagcccaagctcttgttaatcgaagctggttggcagacatcaaaggcgcacttacagttcaggttttattggaatatctccagatttgggaccatgttgagggagttgtcctgcagcaagatgttccagatcagctcagatggaaactcacacagaatggcgtatacagcagcaagtcagcctatgctgccttctttgttggaaccattaaatttgctccttggaggaggatttggaagagtttcgccccttcgttgcaaattcttcatttggttagccatcaacaatagatgttggacagcggaccgtcttgccaaacgaggattgcctcaccctgaggtctgtcctttttgtgatcaagaggaggaaaccattcagcatctgttagtcggctgtgtatttacaaggcagatttggaccttgatcctccaacctctacaactgacagccctgataccctcaccttctgaggctcgtttttctttttggtggaggaaggcattgcgctcagtacctaaggagataaggaaagggcttaactcgctaattatcctggtttcctgggagatttggaaacacaggaattcatgtgtttttgagaatgctaggccaagcacctctttgctgctccagacagttggcagatgagtgtagcgtttggggcatggctggggcaactaaacttcaggaactcctagtgaggtcgctggccccaccagcctaggtcaaggggtttttggtcgaggtcatgcttgttgtcgtctgtaagcttcgctgtgtaggtgtgtgggggtgtgtttcagtgctcgggttttggtccttaaccggacttgttgtgctctcttttctctcttaatgaaatgacacacagctctcctgcgtcgttcgagaaaaaaacacatatgtatttggcaattccacactttgaaatcagttcacaccaattgtcggactttaggtaacttattatagagtacggattaccgagtcagctcatacgtgtttgaatgagctaccatttaacttgtatgattgtctagtttgatcctacaacttgtattggttgttttaatttcttcattcccatttgttctcgtgacaggtttttgttggtatatacaagtttatagcctaccttttgtgttgtataggtactg

SEQ ID NO: 691 - DNA, 1192 bp, Setaria italica
acgctggtgagttccttcgcgcttccacctctgggttttgttcctgctgtttcagaagtggctctgtggttcatcgcgcatcggactgcctgtgcggatcctatggtggccgcggctgttgggctgatggggttttgatgcttgaggattcatgccatgtagttagcttgatgtacgcgggtcacttgggtgtggaaactgtagatgcgaacggggtgtggtaggctgcctagatcctcgactctgctttcggtcaggcgtgtcttcagtgaaacatcaccgatcccctggttcgtttcaacttcaacagcacaaaaaacttcggccttcagaaagtgcagcgataggtcatttgtccgcttcgcttctttacaaccgggggttaggggggtgatgccttagtgctaatgatgtgattcagagtcgctgacctactagtagaatggttgggtgtgcatttgtatagggcctttgacctttgatccagggtgatcatgatattttggtaggggtgtataaccgttttatgtgcaactcaagtagaataatgtatttgaaccattggattcaattaggagctaatatctggtcatcccaacccaagtcattttaagctttctggtccttagttgtaattgagttgtaagttttgaggaaattgttgcacacatagcagtctcttttgggtgaccttgaaaggaaaataagggtgttttagagtgtttatcatgatgcagctcagctacagtgcgtaggaggaattgaagttgagaggtgaagcatgaattgtggtttattttgataatttcgcagttaggcaattcaaaacaagtactgtttgctattctagtcccacctgcacattcctttacctagttgtatttctaaaccatcttgattggcttaatttgcatgataaatgctcctatgtcttgttgggaaacagagatttcactgaccatttccgagtataaacacacaatctgggcaattggtgtctttgcttgtgtatttttccctactatagtgaaacacatctgtcaagtggataatgtttatgttctggttcttcacttagataatggtctagatgtcattacttggcttgcatgtgtaccattaaattaacattcacagaggacttccaatttttaactctatgtctaatataattttcgttgcataggtattg

SEQ ID NO: 692 - DNA, 906 bp, Setaria italica
gcgctcgtgagttccttctcccttcctcctccgtgttttgttcctgctgcttcggtctgctttgtagttcatcacgcatcgcgagtgcctgtggggatctgtgggggcgtatacatagtttggttgggcgatgcacggtgctagtggtgccattcatgttgcttgttactagtagaacggctggctgtgcatttgtaaaaggtgtgatcatggtaattttggcgagggaatttcttcgtggacaaccatttgcgcacatctaagtcaatcatgtatttgagctgttggattcgtttaagagaatattattccaacccaagtgattttaaggctccgatccatagttctatttgggttgtaagttgtaagaaacttgctgtacttgtagcagcgctcttttggtcggtgaaggaaaagcagggtgttttagggtggttattatcatgatgcagcgcagctggcgataagtatagatgaggaattgaagttgggtgatgaagcatgaccatgttgatgtttatttgataatttagccattgtatgggaactcatatctagtactgtttgctattgtagttctctccctgcacatgcctttacttagttgcattgctaaaaccgtatttctttgcttaatctgtatgaaaaaggctcctctatcttgttgggaaacagagatttcattgaatgcttgagactacaaacactcgatctggacacttgtgtgtttgcttatgtatttgtccctactagtgaaacacgtgttttgtggtttatgtatatgttctgtttctttcacttagataagggtctagatgtcattgcttgtctttgtactgtttgattaccatccaaagtatcaacttgtaacacaatatgtctgtattttttgttccataggtattg

SEQ ID NO: 693 - DNA, 906 bp, Setaria italica
acgctcgtgagttccttctcccttcctcctccgtgttttgttcctgctgcttcggtctgctttgtagttcatcacgcatcgcgagtgcctgtggggatctgtgggggcgtatacatagtttggttgggcgatgcacggtgctagtggtgccattcatgttgcttgttactagtagaacggctggctgtgcatttgtaaaaggtgtgatcatggtaattttggcgagggaatttcttcgtggacaaccatttgcgcacatctaagtcaatcatgtatttgagctgttggattcgtttaagagaatattattccaacccaagtgattttaaggctccgatccatagttctatttgggttgtaagttgtaagaaacttgctgtacttgtagcagcgctcttttggtcggtgaaggaaaagcagggtgttttagggtggttattatcatgatgcagcgcagctggcgataagtatagatgaggaattgaagttgggtgatgaagcatgaccatgttgatgtttatttgataatttagccattgtatgggaactcatatctagtactgtttgctattgtagttctctccctgcacatgcctttacttagttgcattgctaaaaccgtatttctttgcttaatctgtatgaaaaaggctcctctatcttgttgggaaacagagatttcattgaatgcttgagactacaaacactcgatctggacacttgtgtgtttgcttatgtatttgtccctactagtgaaacacgtgttttgtggtttatgtatatgttctgtttctttcacttagataagggtctagatgtcattgcttgtctttgtactgtttgattaccatccaaagtatcaacttgtaacacaatatgtctgtattttttgttccataggtattc

SEQ ID NO: 694 - DNA, 998 bp, Setaria italica
  misc_feature (1)..(998): n=a, c, g or t.
  unsure (1)..(998): unsure at all n locations
gcgcttgtaagtgtttctacgtttgagccttttttgtgcactacctggtatctttgggtgcttagatttgatgtgctagatgcgtttaattagctaacttggattagcgaggttgttagcttgtagtttggacttggtgtggtgtggcaagttattttcttgtaaattaattacgttcatgggcttctgtgggctgtagaagctacagcaaggattttttttttatctgtctcgagttcagataaaaattgggcgcaaaattatcccactttgcatgcttcccttctcgcagaagnnnnnnnnnnnnntggttttttttggggggaggaaaggccattgcggttcagtacttaaggagataaggaaaagggctaaactcgcttaattattctgggtttctggggaggattggaaacacaggaattcattgtgtttttgagaattgctaggccaagcacctctttgctgctccagacagttggcagatgagtgtagcgtttggggcatggctggggcaactaaacttcaggaactcctagtgaggtcgctggccccaccagcctaggtcaaggggtttttggtcgaggtcatgcttgttgtcgtctgtaagcttcgctgtgtaggtgtgtgggggtgtgtttcagtgctcgggttttggtccttaaccggacttgttgtgctctcttttctctcttaatgaaatgacacacagctctcctgcgtcgttcgagaaaaaaacacatatgtatttggcaattccacactttgaaatcagttcacaccaattgtcggactttaggtaacttattatagagtacggattaccgagtcagctcatacgtgtttgaatgagctaccatttaacttgtatgattgtctagtttgatcctacaacttgtattggttgttttaatttcttcattcccatttgttctcgtgacaggtttttgttggtatatacaagtttatagcctaccttttgtgttgtataggtactg

SEQ ID NO: 695 - DNA, 3284 bp, Setaria italica; identical to SEQ ID NO: 690

SEQ ID NO: 696 - DNA, 1190 bp, Setaria italica; identical to SEQ ID NO: 689

SEQ ID NO: 697 - DNA, 906 bp, Setaria italica; identical to SEQ ID NO: 692

SEQ ID NO: 698 - DNA, 1238 bp, Setaria italica
acccaggtgactgacctcatcctctttcccccaccctccgtctctggttgctatagctaagttcatccatgcgatgtcctgctagctgattagtatttctactagtggagttcgagtcgttttggttccattcagtagtgcttgtgttgattggattgaatcggaggactcgaagtggtttgctgctcgaatcgcaagtttgttgggctaatctcgatgcaatttatgtcaattcgttgttttagtggtccttggcagttctctctgtgacaggtccgtccgatctgtagagatgcggtggaatcctggtttactcaaaacggttctagattcctctgttgttcccttaatttttgtttacgttaggagcctatgaagtggatatgctcggatccttttctgaaactcatctgtttactcagatctgctggcagctcacagttccagggtagttacgttgatggtctagttttggtagtttcatgttctatttctgtccatttttgtgatgttcagtatgttaaaatactatctgtgcttctgaatatcttgttatatgaattcattgggacaaactatgcattccttttggcatcttaaatattttcctgaaggttagaatcgacttcgaaatgtttgtctaaattaatcttctggtgtttccctatgccagtctgttaatatgtctgtattatagtgttttgtttgaagtggtaatgtacatggtgcaccctgcagtttttcatgtctaatattggatctccttgtttgctgtatgtattaaggattagtttcacttctaatagcttactgctgatgctttcttgtttgtgtaatatgctgtgtaatcatgttgaccctgaggtttgtaagaattcctcttatttgattattgcatggattagtgtcctgaaggatgtggctcctttgtacaattaagataattcacttttttttttctcaacttttatatgcttactagcccattaggttgtgtaaacattagagtgctttagcctggtaaagatgagttaagcattttaaataaatttttggatttggttgatatcatccttaacacctgcatttaaacaatttgtctcttttgatcctgactattacagtgggtgttactttctttagtcattctgtggtatcaaagtttctggtgtagttgtgtaattatggttttggttggattcttactagtattttctacctttaaacagcaggaaatt

SEQ ID NO: 699 - DNA, 1237 bp, Setaria italica
acccaggtgactgacctcatcctctttcccccaccctccgtctctggttgctatagctaagttcatccatgcgatgtcctgctagctgattagtatttctactagtggagttcgagtcgttttggttccattcagtagtgcttgtgttgattggattgaatcggaggactcgaagtggtttgctgctcgaatcgcaagtttgttgggctaatctcgatgcaatttatgtcaattcgttgttttagtggtccttggcagttctctctgtgacaggtccgtccgatctgtagagatgcggtggaatcctggtttactcaaaacggttctagattcctctgttgttcccttaatttttgtttacgttaggagcctatgaagtggatatgctcggatccttttctgaaactcatctgtttactcagatctgctggcagctcacagttccagggtagttacgttgatggtctagttttggtagtttcatgttctatttctgtccatttttgtgatgttcagtatgttaaaatactatctgtgcttctgaatatcttgttatatgaattcattggacaaactatgcattccttttggcatcttaaatattttcctgaaggttagaatcgacttcgaaatgtttgtctaaattaatcttctggtgtttccctatgccagtctgttaatatgtctgtattatagtgttttgtttgaagtggtaatgtacatggtgcaccctgcagtttttcatgtctaatattggatctccttgtttgctgtatgtattaaggattagtttcacttctaatagcttactgctgatgctttcttgtttgtgtaatatgctgtgtaatcatgttgaccctgaggtttgtaagaattcctcttatttgattattgcatggattagtgtcctgaaggatgtggctcctttgtacaattaagataattcacttttttttttctcaacttttatatgcttactagcccattaggttgtgtaaacattagagtgctttagcctggtaaagatgagttaagcattttaaataaatttttggatttggttgatatcatccttaacacctgcatttaaacaatttgtctcttttgatcctgactattacagtgggtgttactttctttagtcattctgtggtatcaaagtttctggtgtagttgtgtaattatggttttggttggattcttactagtattttctacctttaaacagcaggaaatt

SEQ ID NO: 700 - DNA, 1237 bp, Setaria italica
acccaggtgactgacctcatcctctttcccccaccctccgtctctggttgctatagctaagttcatccatgcgatgtcctgctagctgattagtatttctactagtggagttcgagtcgttttggttccattcagtagtgcttgtgttgattggattgaatcggaggactcgaagtggtttgctgctcgaatcgcaagtttgttgggctaatctcgatgcaatttatgtcaattcgttgttttagtggtccttggcagttctctctgtgacaggtccgtccgatctgtagagatgcggtggaatcctggtttactcaaaacggttctagattcctctgttgttcccttaatttttgtttacgttaggagcctatgaagtggatatgctcggatccttttctgaaactcatctgtttactcagatctgctggcagctcacagttccagggtagttacgttgatggtctagttttggtagtttcatgttctatttctgtccatttttgtgatgttcagtatgttaaaatactatctgtgcttctgaatatcttgttatatgaattcattggacaaactatgcattccttttggcatcttaaatattttcctgaaggttagaatcgacttcgaaatgtttgtctaaattaatcttctggtgtttccctatgccagtctgttaatatgtctgtattatagtgttttgtttgaagtggtaatgtacatggtgcaccctgcagtttttcatgtctaatattggatctccttgtttgctgtatgtattaaggattagtttcacttctaatagcttactgctgatgctttcttgtttgtgtaatatgctgtgtaatcatgttgaccctgaggtttgtaagaattcctcttatttgattattgcatggattagtgtcctgaaggatgtggctcctttgtacaattaagataattcacttttttttttctcaacttttatatgcttactagcccattaggttgtgtaaacattagagtgctttagcctggtaaagatgagttaagcattttaaataaatttttggatttggttgatatcatccttaacacctgcatttaaacaatttgtctcttttgatcctgactattacagtgggtgttactttctttagtcattctgtggtatcaaagtttctggtgtagttgtgtaattatggttttggttggattcttactagtattttctacctttaaacagcaggaagtc

SEQ ID NO: 701 - DNA, 1415 bp, Setaria italica
tgcaaggtatatatgcgcttcgatctgggttcgagtactctagtcctgcgattatatctagatgcgcgtggttgtgtggttgaactggctgaagtggtatcctgtcatactatatgatgtcttgatggggataaatgctgttactgttatctctggacggttgacccttgtctctggggatggaatttgtggattggatgctagataactgatgattattcagatggtgggcatcatgtctggggattgaatttgtagatttggatgctagatatttgatgattagtgattgcttagaggaaggtggaaatcatggttgatgagaaacgcgatgcacgtgtgaagggtgccatctggagttagtatgttctgttgaatcttctttgcagagctgcagtttgttatggttaaatttggtttgcttcagtgggggatggtctgtagattgcacccagttcaaattagtagttgaatccgtagagaaaaatggatgttatttttccccttattaaggggaaatctagtttgacatgtacagtgactaactcttggcaaaagctagccaaatataatgtacatgggaactcattctttacacttggttgtcagcaggtctgtaccctcaacagcaattgaggcagtttgccctcaccaataagtttgattttgatcatctatacagtaatctagacaaacgggaagttacttcatgcacagcctgtttgtttaagtccattacaaagagtagcttttggcccatttgtcacccgagtgataaccacgccttgtcctaaacaactatgcttgctcagaatatgcttaacatttttggtagtcaatcttgggcatagtggtaaacatgactttattagggagtttattcatgaagttgaaaaggttagcttggaacaaaaggtaacttgcattcattcctacttctcattggacagggggtggaatttgcctccacattggatatatgacattgcactttgtgattaaaatgttgccatgagtaggatggagatcttatacttacattttataattttctttgggagatctatacctgggttagaatggacaaattgcttcgtacagatatactgatccatttggtgacaagtctaaagctgccaaagcttttcccagtctagttagcttgttgtacactattttagtggttcactgcattcttataaggtgatgataaaatccatgtccttctatgttccctactgtctttttttatattatcgagtctttgatgggttcagtgatatcagcaatgcaatgatgaagttgtccaaaactatttggcatttcccatgctcttaagtagcatcatagttttgtcgggattttgtttcatttatcaaacatggttgataaataaagttatgctgcaggtggtg

SEQ ID NO: 702 - DNA, 93 bp, Setaria italica
tgtgatgtaagttaaaatatctccgcctgtttaactacctttctatgatttacttcataattgactcactgtttcaactcctcttaggtgcca

SEQ ID NO: 703 - DNA, 97 bp, Setaria italica
ggatttgtatgttcttccaatcagccgaagtacctctcttttcggttaaatgttagatttgatatttatcagttatctcaattactttcaggtgagc

SEQ ID NO: 704 - DNA, 593 bp, Setaria italica
ggtcaggtattttgagaaactctccatcgtagttacctatttctacctacctatttctacctcaacgtttttttttctggaaaatagtaaaccattttacaatcattgtgtatgtttcagtcaatcgttatgtatatttcaatctatctcgtaatatatcagtctattttggtagccctcttccatagaatcttgttaatagattttgcatgaaagcagtagaatgtaagaccttatagaacaagaggtggatttcacatactctttatttttcttgcaaggatccaacttggttgccatgtggtattaaaaaatatttaaagtatgcatggcctcaatgtttgccaggctagtatgattgacatgagtttatttataatgttctgtgaccacatcagttcttccatgctcatgtttgactttgtgctgtttctatttgaatgctcctgcgcatatctactgaaaagttgcgtttatttgaatttttgtcattgcactcttgcatgcctgttctgtgattttaacaaatgttgaaatattttatcatgttctaagattgtccaaaaatgcttactccatctaatcagatcaag

SEQ ID NO: 705 - DNA, 115 bp, Setaria italica
tcctcggtgagcggccgcccccgctctctctctctctctctctctctctccccccccccccccccccccctctctctttctaaattctaacaccgtcgatccaatccggcgagct

SEQ ID NO: 706 - DNA, 910 bp, Setaria italica
tggcaggttcttcggtcgggcttgggagatgtcggacgaggagcaccatttcgagtcgaaggccgacgccggcgcctccaagacctacccgcagcaggccggcaccattcgcaagaacggctacatcgtcatcaagggccgcccctgcaaggtacagatccctgtttcccgcctcagcctatttcgttagattcagtggattttggcgatgtccccttacgagcggtgtgctgagctgtctagcctttagtagaccgtaacgcgagaagttgctggtcgaatacctttttgtgctggttagtctgtggcatgtgctgttgtggtggatatctggtcaatcgtacctattgtgtgtgcttatgcattttcgtgccttttaattgtggcgatagcaggtcctgtggcggttcatagattgcttcctgacccttagttacgcagtactgtgattacataaattattcattctctgaaatgccagcttctactgtgatgttcttttgtccctgctctgcattgaagatcttttagtacactattctaatatctagtaccaactgcttgcatttgtgtgaagttcctgtatatcatattattatgtcgagtttatattccattgtatattggttgcgaaatgtgtaattgccatctaactcctatggtttctttcactgtactttgtttcactttattattgatgtaattcacgtgctaatttaggtgttgactggtcttgttgtggaagtctcttaattatgaatcaaagttattgctttaaatcccatttgcattccttcaatggccctggaaatgccattctttagattttgtggcatcttgatggcttgattgttgcagccaaatgatggtgtttactgtcttactctttccctcttcattgcaggttgtt

SEQ ID NO: 707 - DNA, 765 bp, Setaria italica
tgcaaggtacagatccctgtttcccgcctcagcctatttcgttagattcagtggattttggcgatgtccccttacgagcggtgtgctgagctgtctagcctttagtagaccgtaacgcgagaagttgctggtcgaatacctttttgtgctggttagtctgtggcatgtgctgttgtggtggatatctggtcaatcgtacctattgtgtgtgcttatgcattttcgtgccttttaattgtggcgatagcaggtcctgtggcggttcatagattgcttcctgacccttagttacgcagtactgtgattacataaattattcattctctgaaatgccagcttctactgtgatgttcttttgtccctgctctgcattgaagatcttttagtacactattctaatatctagtaccaactgcttgcatttgtgtgaagttcctgtatatcatattattatgtcgagtttatattccattgtatattggttgcgaaatgtgtaattgccatctaactcctatggtttctttcactgtactttgtttcactttattattgatgtaattcacgtgctaatttaggtgttgactggtcttgttgtggaagtctcttaattatgaatcaaagttattgctttaaatcccatttgcattccttcaatggccctggaaatgccattctttagattttgtggcatcttgatggcttgattgttgcagccaaatgatggtgtttactgtcttactctttccctcttcattgcaggttgtt

SEQ ID NO: 708 - DNA, 98 bp, Setaria italica
tgtgatgtaagtagccagtgtgcaccatgttctgtcttgtttcttccttcctgccatgcaatgtgtttgactgtcttttctttaccctgtaggtgccc

SEQ ID NO: 709 - DNA, 99 bp, Setaria italica
ggatttgtatgcttcttccaactcttctagtttcctgaaaatctgttcgtaatgattgcttaagtatctgtacatgttcgatccataatgcaggtcagc

SEQ ID NO: 710 - DNA, 102 bp, Setaria italica
tcccaggttagagctcaatcataatttgtggtctgcttgagctttgtgccaaacaactcttcagatctcttaactccttttctttggtaagcacagatcagg

SEQ ID NO: 711 - DNA, 1014 bp, Setaria italica
tgcaaggtacggtaccggtgcatccccctctcgcttgttacgacccataaagaattaatggcaacacaaatctcctattgtttgttgatttagaggtgtcgcggacaaactgctttgatatctattttgttttcccgtactgatttgtgcgctctgaaacttgcggttacttgcggattcagaggcgtcccaagtgtgagacggatccagtagattcacccgcaagacgactttgcagtgtagtagaaagctttgatctttcgatgcgctttgtatagtttcagtcttggtcatgatttgtatctgaattacgtgatctttggggctgcttaggcatctgcggctccccctgttgtggttctggatgtcttcctttgatctgtctagatttttttttttgtttaatgatgaatggttcaaccacaaattaaccctgggctgtcaacaagatacctgtcttgaccgtcaatgaatatgtttcagttacatatttgtaatactgcaaaaaaatccagcaaggttctttggagaaagcggagagttcatatcttttttgcaagaatttaatgctccttgcactgtttattctgcagttctgaacgacatgtttagatctgcaatgctggttaaactaggactatttccctgtaatttgtatggcttctacttgcccagggagttcttttttatcacttttgctcccagcacctccctccgtatagttgctatctgtagccaatgtccttcatgcatgaaatattgtctgaattcattatctgttcctgctggtatgagttgacatgccattcaaatttgtgtcatcagtgtctggattgatacatgttttcatactggaatactggatttcaatatttcttactaccctatgtttgcttgccacaccatattcctttatagtttgtacatccggtggccatattctctctttagatcttgcaatccaacaagtcttgatctgacaataattcctgtatactctttctttaggttgtt

SEQ ID NO: 712 - DNA, 97 bp, Setaria italica
tgcgacgtaagctatcaagtctcacgttctggttcagttacaagtgcacagaatttgtttgaaccttttgtttcccacttgcatcatacaggttcct

SEQ ID NO: 713 - DNA, 101 bp, Setaria italica
ggatatgtatgtttgcttccaacctagcctttctttcattcagcaactttggcaatgccttcctgtttataacaagcaaggaggccattttacaggttagc

SEQ ID NO: 714 - DNA, 110 bp, Setaria italica
gcccaggtcagtgcgctagctcaaacttggtcaatggcacaacagctttagcctctattgcttccgtgccaactctcttactcactttacgtgcaaccttgcagatcaga

SEQ ID NO: 715 - DNA, 1457 bp, Setaria italica
agctaggtgagctcttcctacctgctctttccctttctgttccctgttcttgtgtgctcatgcttcatgtggccggtccctgttcttcttcgttgatcttcttctccctgctcctttcgatcaatatctgtttttgctgttggagggtggtgggatggttatctgatagggttatgattggtttctgcgggatctttctctctagatttttttaggagctccttgcggcggccaattcctgtttgagttctgctttgatccttcctctcgttcctgatgttttgtcctggtgcgtaaaaggcgcggctaaatccatggtagaggtccaaggctgctgcctaggatgacgttgcggttcccgtccagaaacctgagtttcgcacatctctgttgaattatttttcttttgagttttgcttggatctcaatacctgttctttgtcaaaggagcttgttctaggaaatgtgtagcagccgggtataatggatacgctttgttcctcgtcaggaaaaagattttttttctgcttattaattttcggaggtgggaaattttatgatttttgtgtttcattttgcttcttgatttcctttttctggatgaccttgattccctttgttaagcacatgggtacatgttcttgttcccaactgtccatacctgcttggctgggtaaaacaaatggattcatgaaaaataatttatcttattttatctgaaaagctttcctcccctgctttttgatcctttctctttcccccttgtgatcaatcagaagcgttacttcattagtacgtttcaacatgctttgtgaaggaaaggggaaaaaagatggaaactttacatgctttcttcctatgaaccgccttatgagaagtagttatttggttgacctatttatgggcatatgttttcatgcttgaattctttgcttatatttctttttcatgctgtgtaatctgttcatttatgtggaaacaataaggatcatcctatctttagtccctgttagtcttagccggatcgatttcagaagaaggattgccggggaagtgtccatgtattgttttgatcagatcaaggctctattctgtttcaccaaacacatgctagattgctaactttggcctcccggttgttgcttcaataggcaagcttgctttttcctgccacatgattgtctcctagctgtgtagatctatgctgccgaagcaagaagccctctgttaagtgatactactaatagcagttacttattgcaaatcgtgtaattaccaaattaagatgccacgataagcttcacccagccatattaattacctttttatactgacgcaatcgtgttgcacatgtttaccttcttggcacataattactgatagtaacacggtgattcacctcttaacaatcagcagttgacgtgttcatcttgcttgctgctcctgtgcaggcgaac

SEQ ID NO: 716 - DNA, 1457 bp, Setaria italica
tgctaggtgagctcttcctacctgctctttccctttctgttccctgttcttgtgtgctcatgcttcatgtggccggtccctgttcttcttcgttgatcttcttctccctgctcctttcgatcaatatctgtttttgctgttggagggtggtgggatggttatctgatagggttatgattggtttctgcgggatctttctctctagatttttttaggagctccttgcggcggccaattcctgtttgagttctgctttgatccttcctctcgttcctgatgttttgtcctggtgcgtaaaaggcgcggctaaatccatggtagaggtccaaggctgctgcctaggatgacgttgcggttcccgtccagaaacctgagtttcgcacatctctgttgaattatttttcttttgagttttgcttggatctcaatacctgttctttgtcaaaggagcttgttctaggaaatgtgtagcagccgggtataatggatacgctttgttcctcgtcaggaaaaagattttttttctgcttattaattttcggaggtgggaaattttatgatttttgtgtttcattttgcttcttgatttcctttttctggatgaccttgattccctttgttaagcacatgggtacatgttcttgttcccaactgtccatacctgcttggctgggtaaaacaaatggattcatgaaaaataatttatcttattttatctgaaaagctttcctcccctgctttttgatcctttctctttcccccttgtgatcaatcagaagcgttacttcattagtacgtttcaacatgctttgtgaaggaaaggggaaaaaagatggaaactttacatgctttcttcctatgaaccgccttatgagaagtagttatttggttgacctatttatgggcatatgttttcatgcttgaattctttgcttatatttctttttcatgctgtgtaatctgttcatttatgtggaaacaataaggatcatcctatctttagtccctgttagtcttagccggatcgatttcagaagaaggattgccggggaagtgtccatgtattgttttgatcagatcaaggctctattctgtttcaccaaacacatgctagattgctaactttggcctcccggttgttgcttcaataggcaagcttgctttttcctgccacatgattgtctcctagctgtgtagatctatgctgccgaagcaagaagccctctgttaagtgatactactaatagcagttacttattgcaaatcgtgtaattaccaaattaagatgccacgataagcttcacccagccatattaattacctttttatactgacgcaatcgtgttgcacatgtttaccttcttggcacataattactgatagtaacacggtgattcacctcttaacaatcagcagttgacgtgttcatcttgcttgctgctcctgtgcaggcgaat

SEQ ID NO: 717 - DNA, 153 bp, Setaria italica
tgctaggtgagcgccgcgcgcgcccgtcctctcccccgcacgcttcgttgcttgcagaattccgtgatcgtttcatcctgtctcgtttcggtgcgtgattttttgtttccgctgacgggtggtttggattggatctgggcggaccaggtgcgt

SEQ ID NO: 718 - DNA, 115 bp, Setaria italica
ttccaggtgagagcgcgatcccgtcgccggatctccctcgccgcgtggcctggctgtgttcgcgtgctccgaatcctgattgtcggtgccaatttgctgcttgatccaggccaat

SEQ ID NO: 719 - DNA, 669 bp, Setaria italica
cacgaggtacgtgcgccctggcgagatcccgtagcatgttcattgctcgtaggtctgcgggatcgggcctgcttcatgtgttgggtcaaatccatctgatggagggcgtctagatctcatctgagtgataaggccaggaactgagtcggtctagatctacgtgaaagggacatgagttactgataattgtgccagatctctgggaagcaagctttcaggttacttttgcatcatgtgggggccactgtataaagctttagctcgaagctttactcgagcgttgggtacttattgtggatctgattggtaatgtgagtgatcactgaattgagtgagatcaagcagcaaagtgtgcattaatttatagagctcaagctgcatcatggctctagtccagagtatctgttttgtggatctatttgggattttgaaagatcacaaagatccactgtcaatgctttagagatcctgttagaggtactccattttgagcttcataatagtttccgagtcatgtggagtgctgttcgaaaggatccagggctatttacgttagtgtttttcatgcttcatatttaaagtggagaaaccattgagttctagtatccttgttacagatcctgtctttcggacatttatttgaccctgttctgttgtgtccaggtcatt

SEQ ID NO: 720 - DNA, 764 bp, Setaria italica
gtcatggtaaaataactagttaactatgcattcctaaagacatttggctgtaaatccgcagtggaccttatgactctgcataagcacaaattcaatatcatgttgacatcgctttaagtcttctctttcagagcatcctgaaagttattgatcttggatagtcaatgacacataaagtgtatgtctttatgttgtctctgtgcttgtccttacatgtcctgtgttgttggttgaatggagcttaatattttctgaatttattattgagccttagttgttgtcttgttgacttgtagtactatactcgcaattagaagttgtagttattttcgtcttcttcagaagtccctgaaaatttgaaaatcatgggtagtcaatgacaattgaagtaccatgcatttattttgtcatatattcaatgcttgtacaattgcatgtcctgacttgtctgttgagtgaattaaatttatttttctcttaattggtcattggctattgatttgtaacttactaatggcaactcatatttggagaagcatgtgcattcaagttgattttctgacactgctcgtgttactttcttcatttctgatcacgaaaaatgtgatgatgggacggatcatatactccaataatagtttcatttcctcttggaaaaacagtttaacaaatcattcgtctcagctgttccgttttaagtgtattttcttcctcatgaattgtgcacttacgctgtaaatttgttctcactgttttagatgtca

SEQ ID NO: 721 - DNA, 533 bp, Setaria italica
cagcaggtgagatgtcgcaaggaaaagatagatcttttcccccttttcttttcttttttttaaaaaaaatccctggtgaagatactgttgcatctgtggggcactggggctctgccgtgctctctctgagctcgagcccagctgtgattgattgcttgctcatgggtcacggccatggccatggcaccctcctgcaaaagcccctgcctttggggtcttgtcgtgagcaaaagggagcgcatgtccattattcccctcccttttgcttttgcaacccgaggccaggcaggatgtgtcctgtccccaaagatgcaatctttatcctccttgcacatacctcgcctgcaaaaaaaaaaagttaaagtggccactgattggggctgcttccttaaatcttgcatgtgtgggaactagggagccattggtcacgggcaccgtttcctgcagtccctactgtacctgcgtcctgttagctcactgtttcagtgtttgttcttgttgttactgatgatgttcttgtgattaaggtctgg

SEQ ID NO: 722 - DNA, 813 bp, Setaria italica
cctcaggtaaacatccttctctctcacctgtacttttgtcaatagctcaaggtaggagatttgaaatggttgcttaaaatgcatggaagaagcaagtaaaatggcaatctgattgtggttttcctgttcagtgctctgttttttcattctagatatgaaagattgtcttgctgtatgattctgtcatggtttagttatattttctattgtctttcttgggataagatggtgttttctttggtttgtttcttcaggcgcaacaaggaacttgcaagagaagaatagtgaaccaataacttaaaatgcatggaagtaaaatggtcatcttgttttagttctcctgttagtctatgtctctattatgtattatgtcgtttatatatgaaagattgccttgcattgggattcttgtgaggtcttagttttacgtttcgttatctttcttagatagtgtttccattggtttgtttcttcaggcacaaagaaaaaggttgcaaatataggcaaataatgatctcaatgatttcagttgcttttggaaacgtttcatttctgtgcttcttgactgatgctcatttggtaacattttcctgttaccaatgtgatgccctcatgctacatgattttagatatataaaacacatgctagcattgggattccattacgttgaacaagatgcccaggatatgcgacttcagcattttagatgcaaactagtcacttgggtgatatgaaattctgaatgttgctaaaatttttgggcggtttgtgtcattgtcatatctaatggggattgcattttacaggaggac

SEQ ID NO: 723 - DNA, 451 bp, Setaria italica; identical to SEQ ID NO: 241

SEQ ID NO: 724 - DNA, 638 bp, Setaria italica
cttcaggtacgtctccgttccgccgccttgttccgctcgatcctcggtgatgcgctacgcgttggttagattgattttagtcgggggcagagggggattgttggatccttgggtggaggaaagggtatcaccgattatcgctgtttacatgtggatctcgcctcccgccggtagggggaaggggatttcttcgcgtgcgtgctgtttagtgcatatttgttggggatatgttttggcttgtgcgaatcttaggattctcgcgtggaagaacccgatcctctctatgctatgtgatttcacctaggcccgtttggtttaggctcgttcgtgcgccatctgactcccagtttgctggtgccaattttaggattcgatgaattctgtaggttttacattaacctggttgatcctcgccaggaagaaatcagatcctctaaattcctgtgctatgtgatttctatctaggccggtttggtttaggctcattggtgtgttatctgacttctagcttaaatgcgcttaagtatgttaacatcttggaaatgttcgtggcagagattttttattctttgtggtagccgttctacgtcatgctagtctgtgtctacctgacttatctgttcaatgtccaggtttag

SEQ ID NO: 725 - DNA, 487 bp, Setaria italica
gcgatggtacatgcgcaagtttgatttgtttcattacgaaatttctgtaccactagtcaattgcttgtgatgatcttacgccatgtgctcgcatgatgccttgcgtaaccaatgcaccggatatgtccacgcttatgtgttcgttggatgccaaatcacgtctgccgtttgcactacctttggtcataatcgtgttattaattttgttaactgacgtactttggcatgtccgcatgagtgcacatgggcgttcctgcaatagtgcaatgcagggcatgtaagtttacctgcggggtagtggaatgcagttcttcatcagattggtgcgcgcgtgctgatacacaaattgatatatgttgggataactttattgttgcatgtcagcacgtgaacggaaaactttagtacagatgccatctcagtatggggatctttgtgtggacattggttttgaattggttgagacttggaattatgacaggtactt

SEQ ID NO: 726 - DNA, 351 bp, Setaria italica
gttcctgtaagtactgctgctgcttgatttccctagtttgttcaattgttggagttcttcatcaattaatttagcttatcacatatatgttatttagtcgacatttgcaactaaaatcttatatgacagtgttgtaatttgtgttctgaatttctgatgttcaacttaattaatatacctcatacagtatgcatgtaagtatttattgtctttgacattaagaagccgcatgtaatgaacttatgcactctaggtcctatgaattgaaaatatatgcattcttttcattacatattttcatgtttgtgctaatgcttaccatgaatccttatttggtgaaaacagatcctt

SEQ ID NO: 727 - DNA, 516 bp, Setaria italica
caccatgtgagtggaaccccctcttcagtcctcttctcacccactttccatttccagtggttttgttacctactcgcactgaaatgtctccatccaaaatatcagacatgcaaccaccgtctttccattgtgcaacaaatatagtggcatgttctggaaagtctgttctaattctaactaggttctgtatttattctcacctcacctatgtgaaatattttttgtgaccaaactaccggtaatcattcactcaccaaactactaaaatgatgcagacagagtgtggcatgccattgacaggcatgacctataactacattgctctggcctctgaggctctgtgttaatcttatcacaaaggcttgtctcaatccatgtagttggcatgtattaatctaggctgtgtttgggatatgatatcattctggtcctttgctaacgtacatttaatcgcctatcgatgccgaagagttggtataaccttgttcctgttcctatcattgtttgcagtggatc

SEQ ID NO: 728 - DNA, 1339 bp, Setaria italica; identical to SEQ ID NO: 253

SEQ ID NO: 729 - DNA, 95 bp, Setaria italica
tcaaccgtgagtatccctaagcggcctaccatgatttcttccttcccgatcctctctttgtcactgatgttcttctcctgctcctgcagaggtca

SEQ ID NO: 730 - DNA, 99 bp, Setaria italica; identical to SEQ ID NO: 244

SEQ ID NO: 731 - DNA, 1533 bp, Setaria italica; identical to SEQ ID NO: 245

SEQ ID NO: 732 - DNA, 180 bp, Setaria italica
caacatgtaagctatttcctccttgtcctttgaggttcttggttttttcgtcaataactgtttagtactgcatgcacttgttttgagatttattagctagcatgtaccaaactgaagctgaactttgagcgtttgccccattcttgatcactcgacctcttgcgatgtatgcagaagcgt

SEQ ID NO: 733 - DNA, 95 bp, Setaria italica; identical to SEQ ID NO: 729

SEQ ID NO: 734 - DNA, 180 bp, Setaria italica; identical to SEQ ID NO: 732

SEQ ID NO: 735 - DNA, 795 bp, Setaria italica
cgcggaggtgagacagcaacccactgccaccccccccctccccccctccttctccctgaggttggatcccggccgcgcccatctcgcgtcgctgcaggtcggatctattcctgatttggtctgtttgttcattctctcgtcctggggctggcgtgtgtagatctaggtgtttctgctgtgcctgcatgcagcggggagttgtcgtcccgatatgttcgactcggccagatggctgccaccgcgatggcatgttctgaggagaacctgctcgatttcgcccatctgtgtccaattccggatagagatggtgtgcccgatagcttgcttgttggttagctgaatatgatttgaagggctgtttaatctagatttctagctccaaatttgagtgataggaatataatttaagtcttattttcaatggcgacaagtcatgggaaggattttgttcgcttctggaatccgtccatagacgtgatttttatttttattggggcaaatttcacgtttgacatctccatgaacatttttctgtatgtggatggaatgctagttgaggtccacgtagagtgagtgtgtcctcggttgtgctagtgatggttgggagattgaatttcaatgtgccatcccgtagccaaatgataccgggttcaatttcttgtgactgcttttgttctgttctagacctattgctgtagctggaacatctgattcttctagttactgctctgtctattatctgctatatcatctgcgtatatataaatctaacagaactttgtttctgcagtcagg

SEQ ID NO: 736 - DNA, 1161 bp, Setaria italica
cgcttcgtaagtccacctttgaatttttgtttatccatgaccttttctagctgtatgcttgattgaaacgagagcgccgattgaggaactggtgtgggtaatatgtggggaattaatctgagatttgtatcggtcgcctcttgatggttgtgtagactgcttagaaaagaaaattgtcatggtctcccgtgttaatttcttctattttcgcctgctttatctgatctgggccctatatgataaagataaaagggttttttttttttttgtagaggaggctcttgaggtatggggaaagggcgatacatgagggatttgagatcccttgatcgggaatctttgttcttcggctcgggttgctttgctctatgttcttgaaattcatcaaggggcaacgaaataagtggttttacttatttttttgtttgattaggagatttgggatttgggatcttcgatttgatctctttgatcgaactgaaccattagcgctcgattccctcatcattcatttgtttagtagaccttgtgctgcgtttattgaagttttcatccatcctttgattgaactgaaccattagtactcgatcccctcatcattcatttgtttagtagaccttgtgctgcgtttattaaagttttcatccatcattttgattgcctctactaggtttcaagctcttttactagatgttgctaaggtctgagttttgggtgcatactattctggccacagatctgttggtgcgttcagattagattgttgacttgtcttttagtgaagatctcgagaagtagaacagtattcggtaaaaatattgggcttcctgaaatactaagacatgatgagcgaagtagtggtctgattctgactagtaagcctggctagctggtgaacctatcgttttaacctcccagttgattcctgaaataagtttcctgcatgttccctgtttctggtatgttatacatctgaaataaagaggtaggacagtatatcttttacaactagaaataggtgctgttcttttttcttttgaacaagaaaggccatttctgctggtgactagtcatagcttccttccagctttggttatgagtatgtctcatatttatctttctgcaacctataatctctgaatctctccgttgcagggttcc

SEQ ID NO: 737 - DNA, 1161 bp, Setaria italica
tgcttcgtaagtccacctttgaatttttgtttatccatgaccttttctagctgtatgcttgattgaaacgagagcgccgattgaggaactggtgtgggtaatatgtggggaattaatctgagatttgtatcggtcgcctcttgatggttgtgtagactgcttagaaaagaaaattgtcatggtctcccgtgttaatttcttctattttcgcctgctttatctgatctgggccctatatgataaagataaaagggttttttttttttttgtagaggaggctcttgaggtatggggaaagggcgatacatgagggatttgagatcccttgatcgggaatctttgttcttcggctcgggttgctttgctctatgttcttgaaattcatcaaggggcaacgaaataagtggttttacttatttttttgtttgattaggagatttgggatttgggatcttcgatttgatctctttgatcgaactgaaccattagcgctcgattccctcatcattcatttgtttagtagaccttgtgctgcgtttattgaagttttcatccatcctttgattgaactgaaccattagtactcgatcccctcatcattcatttgtttagtagaccttgtgctgcgtttattaaagttttcatccatcattttgattgcctctactaggtttcaagctcttttactagatgttgctaaggtctgagttttgggtgcatactattctggccacagatctgttggtgcgttcagattagattgttgacttgtcttttagtgaagatctcgagaagtagaacagtattcggtaaaaatattgggcttcctgaaatactaagacatgatgagcgaagtagtggtctgattctgactagtaagcctggctagctggtgaacctatcgttttaacctcccagttgattcctgaaataagtttcctgcatgttccctgtttctggtatgttatacatctgaaataaagaggtaggacagtatatcttttacaactagaaataggtgctgttcttttttcttttgaacaagaaaggccatttctgctggtgactagtcatagcttccttccagctttggttatgagtatgtctcatatttatctttctgcaacctataatctctgaatctctccgttgcagggttca

SEQ ID NO: 738 - DNA, 156 bp, Setaria italica
  misc_feature (116)..(116): y= t or c.
gtacgcccagttccgcgcctatacccccttaccgtttccgccaacacccggtgcctcgcgcgcctcggcgttttcggccgcgcaattgcggtttaggccctgtccagctgagctgycatggtgagcttgtttgcgtgtttttttttgtctccgcag

SEQ ID NO: 739 - DNA, 156 bp, Setaria italica
gtacgcccagttccgcgcctatacccccttaccgtttccgccaacacccggtgcctcgcgcgcctcggcgttttcggccgcgcaattgcggtttaggccctgtccagctgagctgccatggtgagcttgtttgcgtgtttttttttgtctccgcag

SEQ ID NO: 740 - DNA, 100 bp, Setaria italica
tccacggtgagtcttccccgccggtcgtgttgctgcgccccggatccgtcgccgtcgggctccgagcacgggtttgatcctcgcggcgttgcagggagtg

SEQ ID NO: 741 - DNA, 1323 bp, Setaria italica
cacctggtgagtatgctgacgcggcccacatctccatcacgcactgttaactaaaagcttgatttgcatttaagccaagatgctgggccgtggaggattgagtggatgggatggggttctgcgtgatcacagtgccgagatttgactctggctctagtcaatttgggatttaaatcacggttgtgacgcaaaagtgctgtgcttacgtttatggcagtataggtgggattaatttggcggctctgcgtaggtatgggtgtgctatgatcttgcggcgaaggcggcccagttttagtttgagatctgtagtttatgttggcccgcagcgctgcatgcctgcaactctgatcgactgcccttgctgtagttcatttactgttaaaacggttgttactgttgcagttaaatgccatgaacgagcatgcaaacagtgctgagtaatattggcattatttctttagtgttgttttctgagcttgtgcttggccactatccgggatataatctagctagcagttctactacccagtatgcctttatatttaaggaaaatgatcagcatggttcaacacggattctagtgccaccatttcgatttctcaataaatctgcatttaagaatttaacatcatggatatgaagtgttgacctctctagattgtttaagtggattgtttattccttgtcaaatacatggggtgttattcatcgctgttgctttcagctaatgcaagttcatttttctattgtagattgttgaatgttggtttagaaccaaaatgtgccttttgtgttctagttagttggaacctaacccatttacacaatctatgagctgtttctgattcgcacaagcagggttatcgttaattgtttctttcaattttttcgtctgctgcaaacatcattccattcattgagatgcgaggggggggggacaacatttcgtttatcagacagaatgatagtatatttggcacccgatactagatgcgcaacaagatatttaccagtgatcttgtatcctttgcagtttgaactattattataatttccagcagaatgcattgattttaggaacacaaaaacttaaacaattacagtttaggttaaggaattgtttttcttttaactaattcccatagttgcttatttgaacttgattgaaattagcatgctgccatgccctcattaaacaatctttgtgattgtgatgtttcttatgattagtaacatggcagcaagcatttatgtttagcaagaagcatgatttgtgccttttctttttctgatgtaatttgctgctgttatttccagggtcgt

SEQ ID NO: 742 - DNA, 100 bp, Setaria italica; identical to SEQ ID NO: 740

SEQ ID NO: 743 - DNA, 1323 bp, Setaria italica; identical to SEQ ID NO: 741

SEQ ID NO: 744 - DNA, 110 bp, Setaria italica
ttcctggtatgtctctccttcctcccgatcactataattcagttgatgcctgatatcgcgcggcaatcgtttccgtgacatgtgtggaatcggatttggcgcagggttta

SEQ ID NO: 745 - DNA, 351 bp, Setaria italica; identical to SEQ ID NO: 726

SEQ ID NO: 746 - DNA, 350 bp, Setaria italica
gttcctgtagtactgctgctgcttgatttccctagtttgttcaattgttggagttcttcatcaattaatttagcttatcacatatatgttatttagtcgacatttgcaactaaaatcttatatgacagtgttgtaatttgtgttctgaatttctgatgttcaacttaattaatatacctcatacagtatgcatgtaagtatttattgtctttgacattaagaagccgcatgtaatgaacttatgcactctaggtcctatgaattgaaaatatatgcattcttttcattacatattttcatgtttgtgctaatgcttaccatgaatccttatttggtgaaaacagatcctt

SEQ ID NO: 747 - DNA, 508 bp, Setaria italica
tgagtggaaccccctcttcagtcctcttctcacccactttccatttccagtggttttgttacctactcgcactgaaatgtctccatccaaaatatcagacatgcaaccaccgtctttccattgtgcaacaatatagtggcatgttctggaaagtctgttctaattctaactaggttctgtatttattctcacctcacctatgtgaaatattttttgtgaccaaactaccggtaatcattcactcaccaaactactaaaatgatgcagacagagtgtggcatgccattgacaggcatgacctataactacattgctctggcctctgaggctctgtgttaatcttatcacaaaggcttgtctcaatccatgtagttggcatgtattaatctaggctgtgtttgggatatgatatcattctggtcctttgctaacgtacatttaatcgcctatcgatgccgaagagttggtataaccttgttcctgttcctatcattgtttgcagtggatc

SEQ ID NO: 748 - DNA, 516 bp, Setaria italica; identical to SEQ ID NO: 727

SEQ ID NO: 749 - DNA, 105 bp, Setaria italica
gaccacgtgagttgctgatttcatttctcattatcgatctactacatatgtatagtagcatactatatcgctagcgactaactaagaccatgcatgcagtggatc

SEQ ID NO: 750 - DNA, 1339 bp, Setaria italica
gtcccggtgagtacgcacacttatttctcgttgcactcaaagataaattcacagtactgtaccacgcacagtagagtaatcagtgaactgttactgttggttggttactgctagtgcacgcagtaaagggtagtcgatgactaaagactgcagtatactgtagtgtttatgcatacggcccaaggcagaaatataatggatgttagatcatgtaggttacgaagtgttgatgaaggactttgagctgacgtactactagttctttggacttagctcaccaaattattagaacttatgtagcaaactgaatacaaattatttagtatcggagaaaaaactatgcaagtgtaggtccagtgggcgggtcctcttgactttggtgctagagtgcagactgcagaggctaacggtgaaaattagagcgcaaatcatttcagcgcgaggtgtttacagcaacacaaaacctttatgccgtaactcgtaagcgagttgggtagagcagtaaatgaagcgtgtaacataaaagcaacatcctaacaaattaagcccattttttgaacatctagttaaattctgaaattttactgctgctgcctgcttcagcaactatacttttgggaaactgcaccatactagttaccagttcatacagaacatagcaacgaccatatagcaattaaggcaaaaaagctctcaagagactgacaggttaagcattttcaggtcacataatgcacaattagtcatgccatacaagatacgcaatatatcgaatggtcccaaatcctagctgtgcagacctctccaaatcaggcgcatgtgaagatgcatcttcctgcccgatgattgcatgaatttgcactgcatatgccaattaagcagagaggaagattctcttgtgcgtaggcagcagtgtcttcagttgtcgtccctgtcctaatcgctgtcccctacagcgaacttgaggtggctacgtctgccatgattggcacttcttcttgaggataaaatttatcatggataggaacaaggtgcaaaattccaagaggaaattgtggtggggcgatagcctattttgccttcagatttggtaacccatccctttctaggaccacgattttaaaaccctaagctatgttctggggaaaaatataaaaatgtggaactacttgttttgtcagtagctgttctgttgatgtagcggctgaaaagctagaaagactagtactagaatactatttcattttcattatagtatgaaattaaagttactctggggtaactgatcggggagctaaaatataaccgggattttcctttcaccctgtgccaggtgtgg

SEQ ID NO: 751 - DNA, 544 bp, Setaria italica
gaccaagtacgtacgcttaccggtgcttgttcagtagcgtcgacaattaaaaaagtcgccgcgacatgcatatgcctggctactttctcatgctcaattgctagttgacaaaacatgaattctctaatgcaaactaaccagcggctcaggataggcctaaagactatttgttaatctatcaccatcaccacacaccattgcatcatttagtacagctgtttagcttatgcatgacatgtacactcattaaccaaaaatatacaacctaatcccttgccacaccctcctaccttacagacacctaaaagatgcccagtatttgtttggaactactaactaacctgttgtcgtacaccttggcttggtcaagcatttaactacgcttcccacaagccataatcaaacaaatctcttgaggataagcaagtaaaagaagtgcttaggatatcttacattatgcaccatggaaagcatcagcggtacggtgtagtttaattagctccaccactcactactgccgatcgtattgtttgtgcagtggatc

SEQ ID NO: 752 - DNA, 674 bp, Setaria italica
gtcccagtaagtagctctgcactgcggcctctcacctatccagctcgatcatgtttgtggcgcgcagtagtgggataacgatgcttagtttcagatatgaatttgcttctttatttgctgcaaggaaacgagctggtaggaatattcgttcgatcactagacactagtgggggtagtttttcgtgagatggtccctagcattagcacactacgagtagagcagttgtgaggtggcaattcgcaagcgattagcatttgatatgcattctttttctggacaggacatactatagaggtaccaaagaccaatggaagttttcagtgatatgataggtttactgtttgtctccgtttagatatggtgaaccatcgctttaaaggagcagcatgtgaaaaatatatatacagttcattgtcttcttgtaggatgggtttgaacaaactaataacatgtatacacgcttaatttagaatttcaaaaatgtttggaacgtaacagcagtacggaaagaaaattttttttggtcttggcgtactgtatcatgcatggaaataaacataatgctgaattgaaacttggtccgttaactgacggaatttcagaacttttagaaaaaatatacacagtcgtcatataacgttccaaactgtcctgctttgttcatcaggtgctt

SEQ ID NO: 753 - DNA, 625 bp, Setaria italica
gaccacgtacgtcctactacactacacctcgtccttctcctgctaattaacaacctaaagcgctaatggcttcgtgtcaaagaaattaagaagtgctaatggcttacagcatggccggtcactatcactaacaggcccaagcttaactaatcaaacaaaattattgcgatgcttctcagccgtaagttcactagtagcagatagaacccaacagattattttaacattaaaatgtatacgaaaggctcaggaaagtcaggataaggctcaatgatcacttagttaaactgatcagcagatgtcaccccaattgattggtatgcagttttcttagtacgatagcctatgtactactcacagagctacaatgacattttcagccacaagattaaaaacccattaagtcaaaacacgcagtctaatctgttcccaacaaccctccgacctaactgaaaaaactttagcctatgtacctaatactagcttgttccatcttactgttgcatatcatttggaatatatgaaatcgcaaccacctgtaaaagtgtgatgaacataatcaattggagttggagtgtcttgcatcgatcgcttacgctgcctgtatatgtggttgcagtggatc

SEQ ID NO: 754 - DNA, 894 bp, Setaria italica
  misc_feature (313)..(496): r= g or a; w= a or t.
cctctggtgcgtaccgccccttccttccttcccccacttctttagtcgctcaggttcctcccagcgatttcctgccaagaacccccggggggccggtgccggttcttgaatacaattggcgcggtggtttgctattacattctgtagttcgccgtggggagacgaggctagccctggctaatttaagctgctcgccagtgtgtgtgcatacagccggcgggtaggtagtcatggggaaagtgcagagccagccagagcggtctccaattcgcggctgcctgcgcgttattcggctggtggtggatggtatgcrcagagggtgcgcgtgaattgaatttcacagtgtcaaaatgtgatcttggacggggttcgcgttattcggctggtggtggatggtacgcgcagagggtgcgcgcgaattgaatttcacagtgtgaaaatgtgatcttggacggggttttcccttgatgggctaccttccttttgcctgcgtgawgaatggggaattgacttttcttgctcgtccatcaatcatgcatgagctaaattatctggagtttggtgaccatgtgatttgcgaaggtcttgcatccaggttgccatttaacatgcttagggaattctacttcatttcttgttcctttttttgtttatatgtatttgtatgtgcctgtgaaagtcatttcttgcttgctattcagtgttcacagtgaactgtcagtttcatgttatgtctacttccgaataaaaggaaaacagttatttttcatgtaatttctgtataatcaataaattagcatgcaattgaatgtcttacattttgctttttcctgtgagaatgttcccccccttgtttaactctgtctggaacatgtttgactatttcagcaaagc

SEQ ID NO: 755 - DNA, 122 bp, Setaria italica
ctcaaggtacacgagatcgtgccgccgcgcgcgtcgcttgtcttgtctgatgaacattccttctgccggccggtgctttatcgagcttgacgatgagttgacgatggatccatcagggctgc

SEQ ID NO: 756 - DNA, 633 bp, Setaria italica
gtccaggttgctactgctttcctagctctttgctactgtatcttattgtttgcatgttttgcactattgtgacgcctgataaacttgtagttcccgaagcgcactatagctaatcagcaacgtttcgtaccataaagttttggcttctgtgtttagtacaatggaactgtacgtgatccgtacaaaattattttgaaatccaaacaaacatatgatgaagcactaaaaattcaatgattattgtgcctatttaccaacttcatctgcataaacacatcacttaaagtgcagtctacaactccaactttttttctatatatgtgcgtaggtattggaaaagtcagcatggaagaatctgcagttcctaggctaacttttcttttaccgtaccagtgataagatagcctacctacatttccaagaggagcacgccactttatttgtaccatggttcatcaatccttcgtttatttaattatctactatgaaaaaaatatgactacacaataattgacagcctccacatgtgtgaaattttgatattccattcaaggcatgtttctaatgactctcatgcgcctaatctaactagtaatcttctctgtcactatctttctctgtgtgcagggatcg

SEQ ID NO: 757 - DNA, 87 bp, Setaria italica
ctcctgtgtaagcagcagaaacgaccgcgattattatatatattcttagtgatctcaactagctactgaccccggccgcaggttggc

SEQ ID NO: 758 - DNA, 702 bp, Setaria italica
gaggaggtaatggtctcccgaacccaccaggattcgaggattactcgcctcattcgttgcctgttacaacttccaactaattatgcagtagaagagtcgtgtgtttcattggtgcgcaagaatctcagtaaacctcaaatgcaaatgatttagaccctgattcatcaattctggccttgaattggtttaggttcaacgttcagtaaaacaccaatcgcgcttggctagtttagtactttactgtttaccttgaatttgttattagtggtcgcaactaatagaagggacaattcaggttaactgggcgcgttggagctatgttctagcgcattttcgagcttctgctgactatgatgtatgcttgtgttgaaaaataatgtgaaaaccttttatatgagctagattttgtgccatagttgttgattatatggaaagaagagctatattctgatgcgctgaaatgttgtggatgtagcgagagtgcccgtagtttgattccacaattgtataataaatggtcttcgttttcatttttcgaaacataatcttttgctaaagaattaaaacgggtatgtggttttactaaaattaccctttagacatactagcaagtgggttttggtgcagacataccaatgcagacataaaactaccctttagaatgaaagttgatgtagtttgaatcttctatggcagtatgag

SEQ ID NO: 759 - DNA, 102 bp, Setaria italica
atgcaggtaacaattgatcgatctagtcactggaattatattctatcttgctggtgttcaaatctgagctgaaagcaactgggtgtcgttgttcaggtgtgg

SEQ ID NO: 760 - DNA, 193 bp, Setaria italica
atgcaggtaacaatcgatcgatcttttttttaagacgcgcaatagcatgtttttcgttaagtagagagaaacagagtacatacagagcatgcacgaccgaataaacagctcgacaatcgatctgagttaaatgcaactgagtagtaggaagtcaggaactgatgcatgggcattgttaattgctcaggtgtgg

SEQ ID NO: 761 - DNA, 123 bp, Setaria italica
atgcaggtaatataatcgatcgatctagacactggaattcttgctgttacgttgttcatataaataatacaactcaataggaagtttaggaactgatatgagagtgtcgttgctcaggtgtgg

SEQ ID NO: 762 - DNA, 124 bp, Setaria italica
atgcaggtaatataatcgatcgatcaagacactggaattatattcttgctgtttgttcatagaaataatgcaactcaataggaagtttaggaactgatatgaaagtgtcgttgctcaggtgtgg

SEQ ID NO: 763 - DNA, 111 bp, Setaria italica
gcgcaggtacacgggctgactcctcacatcgccgccgccgccataggcgttgcctggagatcttccccggccacgctctgatgctgttcgccgcgtgttttgcaggcgttc

SEQ ID NO: 764 - DNA, 107 bp, Setaria italica
tgccttgtgagtgaccacgttgctttgcctttggttaactttcactggagtggtcggcgatgttgttgttgctgatgttatagtgctgtggttgcagccagatggac

SEQ ID NO: 765 - DNA, 1703 bp, Setaria italica
ggcaaggtccgtgaattctggcctcgccaccattttgtacttttgctgctttgattgctttgtgaatgttagcggacgggtggaaaggtgatgttttaagcatcagttagttgcacggaatgtagtcagactactaggtaggcttccacctagtgatggttagggataatgagaataagaatacactttagagtcatcatttagtctgacttgattgctccctagcataggaatgcaggctgtgctgttagttatgaaggatttcctaattgtatgctgtcataattcatagattggatgcatctgcaagcaaatatattctggcttctcgattgctgtattttgctgattggttgtaatgcagttacctttgtatctgtgtttgcaaatggctgtagataaaccatgtaaaagtgaacaattgatgttggttgtttcacttatgaaactggtaaacatgtgtccggatattccaaatgttgccccccataagaaggctgcaggtccatttgttcttatggccttgtcatgcacatattgtctcatgctgttgttcccatgtttgtttcccagttctgttcaccacaaccttatagtgatccttaaattatgaatcagtacagctgactcaggatggcaacggggcggtgcggggccggggggacactccccgtccccaccccgatccctgatctctgatccccgccccgtccctgaaacctcaatcgggggaacagtttgccctgtccccgcccccgttggatccccgcaccccgtcggagccctgtggggatgagcagccagtattacattcgagcaaatcaggcaaaatgtggcagataagttaacaacaagcaaatccatgagataagttcctaacaagattactagaagcttgcatgctgcagctgtgctccacgaggcagcaaaatgccaacacgtacacaacagacaacactctaattcaatgtggcagacttgcacgagaacgacgggaacagcggtagcggcgctggctgttggaatgcctacagctgaccatgaaggcacaaacaatgcttagagaagttggtcagccgcgcacagatgttgaaagcttgcccttcgccagcacggcgacacctccgcgaggaagagacggcgcatccagcgtctggtccttgcggccaggtggcctcgccttgcgttgtgcttgtcgacttgccgctcgtggcctcgtgcctggtgacggcgaaagtgaggtgagaactcaggagcgagatgaatgaatggagagtgctgggtggcggcggtcgtcctctgtgactgattagggttcgcggaaggccggaaggttggagttttatatatgtacgttggtgtattaagctgttgggctgctattttagatgggccacaagcattcgtgggtccccatggtgccccgcggggagaaaatcacccccgcccccgccccgataatgtttcgggtccccgcctcgcttcccccgcgaggggaaatttgtccccgtcactgccctgttcgggtttggtctccgtggggatctggccccgcggggggaattgccatccctacagctgacaatttacaaccacttaggacacgctagctatgatattatggttggtatgaaagatatcttgatgaacatataaaagtgataagtagttaacatggagttaaacttttcatgcaggatgtg

SEQ ID NO: 766 - DNA, 865 bp, Setaria italica
gaacaggtacataccttattcggagatacttatatacagtatcactgtttgagtagaatacctgattagaatctggtggctgtagtctttagggaaccatttaagttctacaattggtggcgtgtcatacaagggatagatgaccccctggttactgtacaatcagcttatcatctctgccaatttcagaagctcatgcacttcagtatcatctataggctaaaactagaattcagagatggctattttacacatttttcatgtctgaatctcagttcaaatgttgaactaggttcctctaggcatatgcagaacactattagacttttatccactttgccattcatcatttctagctataatctccagaactagatcaccattaaagatggtagtggtaccatttacaggcccattaattgcatatcaaataccttagtcaacttgtctttctattttcaataattcaatagtttgccaatttttaggctactatagatgatgctaataggcgacttccagttttggatttaattggcatggctacaatatcactaataggctggctgaccaattgagttattagttttgcaacactgaattcacgatcatatatagcctatcaaaagatagcgtaacaatggtttttatgggcattaattgtgtatcaggtacatcttgagtctgaattgtatattccaatgaattatttaccttatgtttgtttagcatagtatttagaaaccgtcagcattacctgcatgcaggacatggtgatagatattgcccacaccaatgtgatattcctttatctaccgattcttactctatttttcatttgttgtctttggtcttgcaggctcta

SEQ ID NO: 767 - DNA, 94 bp, Setaria italica
tgagaggtgagctggaagttgtcctgtgatcttgtgcctggacgctaatgcagtcagtctaatgctttgttggtctgatgttaaccagggttaa

SEQ ID NO: 768 - DNA, 580 bp, Setaria italica
tctattgtaagtccattaattcttgttttgctggctatttctacatcacatgattgcctattcatatgtaattgccaccagtgttcctttttaagctcgagccatttaaaaaatattgtatgccctgaccccccatcactggttacacagtgtcatagagctggtacaaggtttctaatgtcatctagctttctcttttcaccagaagtcttgcttttaagatggaaaagttatcacaaatttagaattttggttggtccatgatacctagtcaaatgttcaaaaatcacaaggctctagatgggccttgggaggtgtactgcctgattgccagtatggaacaatatgtgaccattaggcgctaggcgccactcttcgcctagcgcctccaaagttgctaggcagtaggctctggaagtctctgtaatgtactttgtatgatgaacttaacattaaactgtacttagcctgttttactgttttcatttgctgatgaagcctaactgcacatgtctcatactgaaccttattatcattgatctacgaaatgtaactgtgagtgatgtgtttacaggtgtgt

SEQ ID NO: 769 - DNA, 3284 bp, Setaria italica; identical to SEQ ID NO: 221

SEQ ID NO: 770 - DNA, 779 bp, Setaria italica
cctgcggtaagcctcctgcagttttccggcctcctccattgtgctgcaatctgtactagattccggaagctgatatgcatcatagatccctagttcttgcttcgattttgttcgctcgagttcatggttgcgtcggcatgttgctgttgctttcttggatagctttccctgagagcgagaccaaggggaaagcaacatgagtgttgcgcctttcacttttcctttacattgaggcagtcagatttagttctgggattgctactatgcttgatcttcgcactcagtattcattttattcaccttgccctcgcgggatgggaaaaatgatttttttttccttaggcaattcaaggagcgcagttatttgttgattgacctaaatgcgtgaggaaagctacaatgttgtcttgctttgattgtgggtaaatttgacgttaaaggctcccatcacacaatgctgatggaagggtggctgcttagctgtactttgtaaggttgcttggtgacgattttgtcaggttcattggatttagaccacacaatcctgaagcatgctgaatttctgttcctaattttctttaaactatacattgtccttactcacccctggaagaccacacaatgctgaagcatcctgaatttctgttcctaattctgtttaagctgtacattgtccttactctcccctggaattaggaatttaattctgacagatgttatgctacaattcttgcatggttgctgaaatgctgcgagggcttgcattgttgcaggttggg

SEQ ID NO: 771 - DNA, 937 bp, Setaria italica
ccgcaggtattatcacaataatctcataccattcctgtatgcatcattttgtcatcatatttgcatctatgcagtcaccattttcatgttttcttgtggacaataaattgccaatcaattaccacccaagaaaaaactgtagtattcagtgtgtaacattaaaaacaaaatgaattcagtggtagttatgagttgtgatttggtgaaactatggatatgaaatagtaccagtgacaaaaaaaaacattcccatgttcttatcagttttattagacgacaaaatctcaatttaaccaatatgattaatcaaatatcttatagtaatttcataagggaagtttagatacgagtcatactttcattctttatataagctacttatctatgttgcttttgtcgagtttctggaagagctccaataaagtataaatttcattgccactacagttgagctacctttgtcagtgagcagacctctttatttgttcttacagtaagatatagcttatctacagaaaaatatccttccgtggccgacattcacctatcattgattggaccaaaagtaattttctcaacagaacttcttgagagttactatattaagtataagcctggatatcatgtgatcccatatatatctaaacagagcaaagatgtgagtgaatatcagtaagaattttatgccctatcacagagaacagtcattcttcttattgtctacataaaggttataggacaagatctaaatctgtatacttgagtctagggtgagtaaacagacttcatttgtattctcaacagtactatttatgtacctagctatagatgtagttgtttcttctcagtctgataacaaaagcttgcaaaggaggtttacctgttattgtaaagtacaagtactctgtactgaaaccatttcttgttgcagatttca

SEQ ID NO: 772 - DNA, 934 bp, Setaria italica; identical to SEQ ID NO: 264

SEQ ID NO: 773 - DNA, 447 bp, Setaria italica
acacaggtgtgatatgccgtgcctcaccttgaaccatttcctgaagaaaaggaaatatcctcagaaatttaaaatgctatattgatcaggttattattactcttggagtttggaagcgttatcttggattttggtttattctaggtgcatttacaaactatgtaaactatatttttatgtatttcaataattctagaaagtgacaggtagaactgatccacataaagttggatattgcagggacaggatccatacttaaatattcaatcattctatgctgcagatactgttcatactacacaatcaacatcacttttttaaaaaaaacttagggcaccttacttcaaaaagattggcatgcttgggaaactgtcacatgctcgtattaatacctatcctgtctggggtggagtgaattttaaagttgtttttctgttgcagttggaa

SEQ ID NO: 774 - DNA, 447 bp, Setaria italica; identical to SEQ ID NO: 773

SEQ ID NO: 775 - DNA, 956 bp, Setaria italica
tttcaggtaccgatccgtccatttcgccttcgttttcgcttctcgatgccagatctgtggtagatcagggcgtatgtcgggttgatttgtgctggatttagtggatctgagtaggggggggggttatggcatttgaaatctgtagaactgtgcggatctagctgtgtgtgatggtggctgcccagatctgcgattgcttggcataagccgtaggtctggtgaaatggtggctatttgcagttgttattattatagatctgggtatgcagatgtggaatttgaatgggaattagccggaattactcattattttacctggtgttgttgattcagtagatctgttagcttaattgatgctgatttagcttattcttgggtggatctgaacattgttggtctctattttaagaaagtagagtctccggttcgtaacatctgtttagatctagatgcttgttgtgtggaaaaatgtgcttattataatttaacgtagatattgttaaaaattcgaatcattctcagttagaagtgggctagtgacggctgtgttttgctattcaggtttctgcagtgttcatgtacatttgctaaataatgtccttgcaatctgtaattaagcatgatacattaggatgtatgaattcgatgtaatggtttgaaaggcatggcctatgtgttgttattccttgtaagatctagatctgcctgctgtactagagtgtactaggctagttggcttagaatgtgtctatgcctctcatgtacatgtattcctagatcttattgatcagtcataattatattacctagatgttaacttgctcgtacaggcagtcgtgtggtatgcagttatcttattagcttgtttatgatgtgcctttgtgttatctaatctaactgtttccatttgtgatttgcatctctaatgctgcttgttttgctctgttcaggctgat

SEQ ID NO: 776 - DNA, 777 bp, Setaria italica
ttccaggtccagtcgccgcccccctctcctcccgtccatcatctcgtcgtcctcgtcgtttaatttccgatttgattcagaggagtcctgcgatttgcagttgcagggcgttagaattctgatttggggtgaactgttttgggggaatttagtcagatctgttggtgctagtaattttagggttcgaaatttgctgcgcgattcaaactgtgattgaggctggaagtaagtagttgctgtcggttttgttgtgcggtacctttgcagcggaagtaagtagttgctcccatcgaatcgaatttttataatttgcagttgtgggtcacgcgttacgcctgctctcgtcaaattgtgcagtgttatttaaatgcttctgtgctctattcgtagtcatcagttttgatcggtttgtgtgtaattgtggatgaattgcgctatttctaaagtttcagttatagtgtactagaagttgattagattagaaaaacgaatatgccttctatcaattcggtggatcccgttcagattctttaaattaagtcatgttcgtaccatttcttagatctgaatgcaaattggactagaggttgtgttcggtgcatgtatctctgagcaactgatatatcgcttattgatgcactgcataatggctaattaaattgatgcatatcataagttgctccacttattgataacatgttgaacccgtgcaattgctcctttgaaccctttataatttgcatcccattaaactgcttttttcccttgcagcctgat

SEQ ID NO: 777 - DNA, 1002 bp, Setaria italica
  misc_feature (94)..(402): y= t or c; r= g or a; w= a or t.
gtataaattcagttccttgctccgatcccaatctggttgatatgttgctccgatgcgacttgattatgtaccatatctgcggtttgcaccgatytgaagcctagggtttctcgagcgacccagttatttgcaatttgcgatttgctcgtttgttgcgcagcgtagtttatgtttggagtaatcgaggatttgtatgcggcgtcggcgctacctgcttaatcacgccatgtgacgcggttacttgcagaggctgggttctgttatgtcgtgatctaagaatctaaattaggctcattcgttcttgctgtcgactagtttgttttgatatccatgtartacaagttacttaaaatttaggtccaataatattttgcatgcttttggcctgttattcttgccacwagttgtcctggtaaaaagtagatgtgaaagtcacgtattgggacaaattgatggtttagtgctatagttctatagttctgtgatacatctatctgattttttttggtctattggtgcctaacttatctgaaaatcatggaacatgaggctagtttgatcatggtttagttcattgtgattaataatgtatgatttagtagctattttggtgatcgtgtcattttatttgtgaatggaatcattgtatgtaaatgaagctagttcaggggttacgatgtagctggctttgtattctaaaggctgctattattcatccatcgatttcacctatatgtaatccagagcttttgatgtgaaatttgtctgatccttcactaggaaggacagaacattgttaatattttggcacatctgtcttattctcatcctttgtttgaacatgttagcctgttcaaacagatactgttgtaatgtcctagttatataggtacatatgtgttctctattgagtttatggacttttgtgtgtgaagttatatttcattttgctcaaaactcatgtttgcaagctttctgacattattctattgttctgaaaag

SEQ ID NO: 778 - DNA, 165 bp, Setaria italica
atggccgtaagtcccatcgatcgatcatctcttcccttctcttgtcgtggactcaaagctcatcgtgtcttgttgtcggatgtacgtgatggcgtgcatcgtgtcattggtgcatgcgtgtgtcatgtgtgtgacgtgcacgtgtgttggcttgtgcaggcgaat

SEQ ID NO: 779 - DNA, 245 bp, Setaria italica
atgatgccggagaagccaaatttttgtaacagtgtttagggggcttatgaatgactcttgggggccggcggtgacggagactaatcttcttcctctgaatgggtgtatcgctgctcttttagctgctgagtgtagaactctggttttttttttttaaacttccttgtgatttttcttgttattatagcggattcgcatcggaatttatgtgaagaaaagaagatgcttcgggatttaaaaaaaaa

SEQ ID NO: 780 - DNA, 273 bp, Setaria italica
ttcttcggcaattctttgggcccaagaaatgcaagctgagaggagccattatcgccagcctccttccccatttctttctctttttgttactgtttcttcattagcgtggacaaagtttccggccagtctatctgcgatcgttttcttctattcatcaagactgtaatatctattgctacctatgcttctcacttgtgattttggacacatatgttcggtttattcaattttaatgagatgcctgatgaggctactagcaaaaaaaaaaaaaaa

SEQ ID NO: 781 - DNA, 301 bp, Setaria italica
tagctacgcggttacgtactcgcatgcaacacgcacgcatgaatacgggcagtgtttgttcgtgagtgcatgctgcatgcatcgcgtttgttttcgccgaattttcttttgtctgcttgctttgtctgcccggtggttctgaatgtagaaccacggacggatcaacaataatgtgtgagttgattgtttgtgttttgcctttttcacctttttcatccttcctccctctaattgtatggctatggagattttcttctccaaggtccaagctaggaaatgcatatgcatgtaatctattttt

SEQ ID NO: 782 - DNA, 424 bp, Setaria italica
agaagaagagtgtccgtctccgtgcttatcatctacctcttgctgctgatgttacccgcaagcactgctgctgctgctgctcctgctcgtggatgtgtgtctgatcagtgagtgactggctgcttccttagaagaagaagaagatgcagaagaagataagaaggctttggcaattgctgcagcaaagccatgtcgccgcccggcggcttagtgattggtataatttggtgtggcagccaggattacgcgctggtctttacctgtactagtttggtcgtccggtatctttttcctcttttgtttctccccctttttcgagtctgtactaccgaaactgccgagagatttgcagttttgatctatcataattcctgtgttactgctgtcattcggacgcaaaaaaaaaacaaagtctagacgctct

SEQ ID NO: 783 - DNA, 244 bp, Setaria italica
gcttgagccgtcctccttatactaaaactgagccgagctgagccggtggtggcgttctttcttggtgcggtgctcctgctatatataattctttctctcgccttcttgctgttcagtctgtctgtaattcctgatagcacaaacacaaagggagttctgtattccatgctcgtcgtcgcgagatacacaagaatttcaattcagagatgccaaatgtataacccgagtatctttatcttgcaaa

SEQ ID NO: 784 - DNA, 283 bp, Setaria italica
gtcgacggggagtgatcaccaatttggtgggctgatggggacaggaggacatacattgaaacgcgatcgatgtgaattcctttctgtgtggatcatcagtttgtgatgtgtgtttaatccggagaggagattaaggactgtgttgtaataatgctgtatgcatggtgaggagagtgagtactgaggggtgattggtatgtacattaatgacaagggtggttaagggtagagattgtttgatcagtatcttatctctcgacggggttcgttccgtgccttttta

SEQ ID NO: 785 - DNA, 239 bp, Setaria italica
tgtgccctctgctcgtgagtaggcgtgtagtagttgcacgcgccagcgtattgctttgtgctcgtgagctcttcagatcagaccagaccagaccagctagcagctgcctggacgtgcccgacgatgtaaaattattgtaaactaagcacagatgcgtatgtcagctgatgatgaatcaatgcaacggtgtaccattcgtgagtggaaaaaaaaaacccacgcgtccgcccacgcgtccg

SEQ ID NO: 786 - DNA, 372 bp, Setaria italica
  misc_feature (1)..(372): n=a, c, g or t.
  unsure (1)..(372): unsure at all n locations
tgaggtgaatactgttaatatggtctcgggtggctgagttgtacttcctgagacaacatcgtcgacaatcatgacttccttgttttgttttcaccttgagtcatttggtcaattgtttgttcccaacctggtgttgaacaacagcgcattgcaagatggtaagaagagcaatctacttcttaccatcagaacagatgatcgtggcgtgagcatgaatatgtagaaaataaacgctcatacttgaaaggcttttcgttttgtatgtgataactgtgtaaattctgtttgtggaactagcagggatacatatttgggttcttaaataaaattggtcccgggtagactacgggtttcgcctctagnaaaaaaaaa

SEQ ID NO: 787 - DNA, 261 bp, Setaria italica
gcgactcgtttctgagtcgtctgcggtggcgccaggtggaggttgctgccgcgagttatctttgctctgttttatcgcacttaatctatggtcggttcggttggcactttgtggtggtaaatttttggacctcgtgatggtcggtcgggcggtcggtgggttagtagcgtccgctgcgatgctaaatatgggtcctcgcggctgacttgtggtgtgtaccagtcgagccgtctaagtgtacaatatttattctggttcgtt

SEQ ID NO: 788 - DNA, 383 bp, Setaria italica
tacgcgctgctagtagccaagtacctacctcgagggcacactgtaggcagtgtgccatattacaggttcagattggccgggacaaagagtacactgcgattttactatcctcggtatgctggtactacaggttcacattcacatggttactacctggcctgtggtatgctggtactacaggtgttgctctgaatagctcaggcttgacccaagtaagagcagtgcaaattcccaatttccagaaaacaggaggacctccaaaggacttcaatgtaattaaaatttctttcagaggtccttttgcaaggggctggatgtaaagtacttttataataatccaagccattgtgcttctcaaaaaaaggaaaagaaaaaaatttgtt

SEQ ID NO: 789 - DNA, 383 bp, Setaria italica
tacgcgctgctagtagccaagtacctacctcgagggcacactgtaggcagtgtgccatattacaggttcagattggccgggacaaagagtacactgcgattttactatcctcggtatgctggtactacaggttcacattcacatggttactacctggcctgtggtatgctggtactacaggtgttgctctgaatagctcaggcttgacccaagtaagagcagtgcaaattcccaatttccagaaaacaggaggacctccaaaggacttcaatgtaattcaaatttctttcagaggtccttttgcaaggggctggatgtaaagtacttttataataatccaagccattgtgcttctcaaaaaaaggaaaagaaaaaaatttgtt

SEQ ID NO: 790 - DNA, 377 bp, Setaria italica
tacgcgctgctagtagccaagtacctacctcgagggcacactgtaggcagtgtgccatattacaggttcagattggccgggacaaagagtacactgcgattttactatcctcggtatgctggtactacaggttcacattcacatggttactacctggcctgtggtatgctggtactacaggtgttgctctgaatagctcaggcttgacccaagtaagagcagtgcaaattcccaatttccagaaaacaggaggacctccaaaggacttcaatgtaattcaaatttctttcagaggtccttttgcaaggggctggatgtaaagtacttttataataatccaagccattgtgcttctcaaaaaaaggaaaagaaaaaaa

SEQ ID NO: 791 - DNA, 411 bp, Setaria italica
agcgtcatctccgctccatggttccttcccgtggcctctgcggtcgtggaacggccccgctgcttgtctatgcagagaataaaatgtgaaatggtgtgcctccggacgccaggattcatgctaagttgggacatgagttgccttttgcttttcctacctgcttgctaccttcatgtaacgaagttgctaatatgggacctgagtttagtttctggttgtgaagaatatgaacggttcggttgtaattttgctgtgtttagtcggtttggttgcatagatgagctttgcgtctttggaaataatagtttcatgttttgtcccgcttcaaaagaaagaaggggggccggtcgaatagatccgagtgtaggtacggcgggcatggtgaactctaagctgcttctataatggcac

SEQ ID NO: 792 - DNA, 504 bp, Setaria italica
tggaaccgtccctgcagtggctgttcgtttaattacaaggagggtgccatcaaagaagccatttgtcttgaatcatatggaccgtgtacctgctcgtctgtgggttggattactatttttcttggcacgattatcgcaccctgctcatacctgtgttagtcttcgtgaatgacgtggttctgaggcaaagtttcccgtgtacttgtattgtaaaaccgagtggatgtctgcagtgtttcatctgcaactctgaggtgtgttacggctcgtattaatgatctttgggcaagaaataaatctggaagccagtcgttgctgttgctttaagatgaatggtccactagcgttgctctgtaactttgttctggttgccattgtgatgtctagcgtctgccaataaaggatacgtggtacgtccaggttgacgagctgaatctttgaatgggctatgctgaaggagctgcttcagcctttactttgttgttcgatctgtgtgtgtttttt

SEQ ID NO: 793 - DNA, 203 bp, Setaria italica
acgtccgtcatggatgggaaagtgtactatgaaaaacttttgagagcaaaggagtacgcattctgtatctattaatgcaaattcgggctgttgatttgtaattctagtatgcatttcttctttcttttgttctcatcaactcgcatgtattgcttactttcactactagggaatggagctctcgtcccgagactgatcataaa

SEQ ID NO: 794 - DNA, 437 bp, Setaria italica
gacaccgccgggatgtcgacgaaacctttgcccgcccgcccagtatttgcgaatggagtcatctgattactacaggaatttttccggtgatgaaccaaaacaaagaaaaaaaccgtgtggctgatctgaccgagcagccctagttgtaaagcgctataccaccaccagatactgctatatgatggtatggttgggtgccccgtcttgctagggagctttttttttctctctcctttcactcttacgcttttcactagtggagtgtgcgcgtggtgtaatcgtttttacttgcgttttcccctaactagcccggtgatctcgcggaatgcgagatggagaaataatgcaacaaaaattttctgccacatcccatagtgctgttgtgttctctcctcacttttgagtcatatatatataatcaatagtacaattactac

SEQ ID NO: 795 - DNA, 262 bp, Setaria italica
gggcaccgcctcatcggcaaccggatcacctgctgttggtgcgtctggtgaagaatactaatacaaagccatggaacggtggaactctgctgcctggcaaaggcccgttgtatcttgtatgaagtctccgtgcgcgtgcgcatgtaagacttaatgtgtggttttctgcattttcccttgaactaccatggtaatgtagtaccaaacagagatgatgacgaagaacaatcgaataaattaattggcgattacctgtgctgtc

SEQ ID NO: 796 - DNA, 388 bp, Setaria italica
ggtgctctgcttcgctcgctgcagagtgctgtaaaggcaccagcatgtggatgtgtttctttatgattcacaccttggctttcgttcatgttttcttttcgaataaggcttgatgtaaagatcaagtggaacttcttggctgtttaagcattctgtaattctgtaataatataaagaccacaaactattggcatgttatatttaataaagatatttattccaataagataacccctgctcaaaaaaaaaaaaaaaagggaaaaaaaagaggctctcaaaagttcgggagtgcccaggacgacctggttggcaaagatatctttatagagcaataataattttgctaagatgaatgtggctaccatgctcctcctcatttcagttctct

SEQ ID NO: 797 - DNA, 233 bp, Setaria italica
agtgtttgtttggctgcctatcgctcgcgccgccgcctatgtaacctgcgtgcgtgtgcattcgttgtgcgcgcatgcatcgtctcgtcccaatgaacatagcttgttgctgcttttggccccagagcctatcagcttcagtaacccacgtcgttcgtactttttttttcatggaacaaatcttcagaaacttcaaagagagagttcaaattgcaataaaaaaaataaaaggt

SEQ ID NO: 798 - DNA, 148 bp, Setaria italica
acgtcctctctacatgcgtgtgcgtgcatgggtaggcgatgaggtcgttgattgagcagtgagcacgtgtataaatgtacttcaagtaacttggaacttgaactgttgatttcttacttggatggagttaatttacttggggataaaa

SEQ ID NO: 799 - DNA, 196 bp, Setaria italica
gggggcttcctcgatcttcctgtctgtcatcagctgctcgtagccttgagttcctgtgttccttctctgagggagggctataaattcacttactccatgcctccaaactattacatatgtacacaacacactgtatgaaacaagaacacctctgtttctcatctctgcatatacaacctttttgattgaagactct

SEQ ID NO: 800 - DNA, 218 bp, Setaria italica
acgatgcttcctgctgctgtgtcaggcctgtgtgccgcggttatcctatgatctgcccgagtggctcctatcttatcttgttgtgtgtcggtgtgtcggtttgaactgttatctgtcgtcgtatgtcgtttacaacatcttatgttgtaagaaacttgtttaatcctgcttcgtttctggattaataatcctgttatgtttcgtgtcaaaaaaaaaaa

SEQ ID NO: 801 - DNA, 1909 bp, Setaria italica
agcccggaagaacgcaaagtacctgagggcatttgcatgagcaagctctgtggcacgtttgtaacctgtcgaacaaacaacgtggctctagtactaaataaaagctgcgtgaacgtattgtgatcgtgctttgtttaagcaaagtgttgtggttatggtttggctaagcaacgaactcatcttttatttgtaataattacttaaggaactggcagttaagatttgagacgtctcctcaggtagtagagttggaaattctcatgccaataaagtataaatttgatcctctgcaaagccagatgagcaacggccagacctttcgtccaaccctctttagatccggataaaatcggacctgtgactaaagggagaccctttagtcccgggtgaaaaaattagccacctatagggaccctttaatctcggttggtgttacccaactgggaataaagccctcgaccctttagtcccggttggtgttaccacccgggactatagcactagtagagaactagcttttagtcccggttggtaaggtgcatatctcccaaaaatccatccgggataaaccaaccaggacaaaagggaaggggtctttagtcccggttggtgtcaccaaccaggactaaagggcctgccatgccaggcatgggataggccctttactcccggttggtcaaagtaaccgggagtaaagggtgcccatttagtcccggttgggtttcccaaccgggagtaaagggttaccctttagtcccggttggatttcccaaccgggactaaatgacgcctgaaattttcatgcatcgcgtacgtagtaccgcggcctttttattaacctttagtagttgagattttttttataatgaaatcaactagtatttaaacgaatgaaatttgtaattatacaattactatatatatacacaattcaactagtacaaatcgatcttaattagcgcgtattatatatataaataaatcaaactatatatctacaatcttcccgtcgaggtgttgctaggagcgtctaattgtcgtccatcgtaataaaattctccttttggatttaccacctcgtccattaggaatccaatgagaccttcacatattgccgctactctttcttccttcgagagtccttgttgaatatttaacatctataatttggaaatttgtgaatgttacacgaacaattaaatataaggagctagaaaataattaactagtaatagttttattttacgtactttaaagttgtgcggcgtcatctttagtcccttgggtcccataaaactgtgcatgtgctcacagatgtagtagccacatagattattcccgggttcctgtcttaagcacttcagtgtggaaaaaaataagttatgaaatattcgtgttatacaatgtaataaatgtgcaaacttcatacgtaccgggaagtctgtgttccatgtaagtttttctttgaatggacctttgtgtgtccttatgaattgtttccatgcgctgcggattagaataatgaatgatatagtgtaatagggataaaatttgggaaacaaacttttgcatagagataaagatccagaattattacaagcctagcctgtcttgcatgtcttggtactctactggatcttttctcaaggaactgaagacaataacgtggcttctttcaggctcaattataataaggatccagtggaagctgcgtacgtaaactgttcatgcatattagagctaactaacattaatcaggtaaggaaaaagataacaaaagtagacggtatacacacacttacttgaatttgtatggaagtagtatgaaatccttgaatgtttgtttgtctaggaaattgtatacttccaccaaggttttttccggtgataattgtttctgtttttggtt

SEQ ID NO: 802 - DNA, 275 bp, Setaria italica
gactgcacacccttcaaaatatgttcaatgtgtggttcactatggacatgaccatgtgctgtgaggaaaaaaataaatggagaacctcatttcctagataaagtttcagcgatctgaaagcagatgagctgttcagctttcttgcattgagatccatgtagtttctgcttgaaatgtactagagtactcttcgtggtttccagtgtgctatgttgatttgacttcgaccatatatgttttatatggttgtttgtttatgtgtaagttatgtacaa

SEQ ID NO: 803 - DNA, 248 bp, Setaria italica
tgaactgatcgcggtttggttcagagacacttgggaaattaaattggccgagtgcttcgatttgcttatttctccagcttttggttgcttggtttgttgattcagtgctctcatcagcttgttgagatttaccatttgttctcttcaactgtgtatgtatttttcttgtccatgtgttgttatttattcccttatggaaatgttgttcttgcattgctagagtaacccatttctattgtaagttggag

SEQ ID NO: 804 - DNA, 349 bp, Setaria italica
ggttctgttgaccaagagtgccgagacagcagcactcgtgaaggcatatgctgctgatgtcaatctcttcttccagcactttgcacagtctatggtgaacatgggcaacatttcaccactaactgggtcacagggtgagatcaggaagaattgcaggaggctcaacaacgaccactgaggttgctttatgtgctgaaattgtatttgatgttggtgatatattttgttcaaataagcaagcatggctatgattttatcagatgtttgatattgtgcttttatttaaccacattgtaaaatgtgtatctattgataggtcaatatataagatgaattcattgggtgtaac

SEQ ID NO: 805 - DNA, 409 bp, Setaria italica
  unsure (1)..(409): unsure at all n locations
tctagcaaccaataagtagtactacatacgaatcagtagtactgcactatgaacttatgacttccagtgtcaataagatttttgtttctctatgcaaaaatatttcctattggtatggtcagggggtgtttgtttctttagtgcctcctaaaatttctgtcacatcgaatgtttntatactaattaggagtattaaatatagactaattataaaattaattgcacaggtggagtctaatttgcgagatgaatctattaaacctaattagtcatgatttgacaatgtgatgctacggtaaacatgtgttaatgatggattaattagacttaatatattcgtctcgcaaattatcttccggtgtaattagttttataataagctcatatttaatcctcctaattagccttc

SEQ ID NO: 806 - DNA, 205 bp, Setaria italica
tccggcacgtccgcggcatgtgatggaggatatgcgtgcagattatttcctcatcgagtaccaataagacaataattgttgttcctgttgttttctgctacaattgtgtgtatgtacttttgttgttgcatatatgtatttattataaatattttattttaaaaaatgcattacacgacttgtgtagcggttatcatcataccaa

SEQ ID NO: 807 - DNA, 200 bp, Setaria italica
acggcatgaaagtccgcagtccgcacccaacccgacgtgtcaatttcatcatcgtcgattgtcacctcgtctcgtcttgtgattatgtttggtcttctttgaatttcccttttggatttcaccagcgatgatgtcagcaagttgtaagagaaccgttcgatctatacacatgacatgcacggttcagcgttcccaagtaa

SEQ ID NO: 808 - DNA, 218 bp, Setaria italica
tagcaggattgcaccggaacatggcatgatgatgtgtactagctaaataaatgtcatgccttagatgtgtactcatgcatgcttatccttataactttcatttgaataagtaccggtgcatgtgatgaaaatggcaaataaacatcctccaaccagatggcgttggatagtatatatgtacgtacattgatattttattttaatgttaattatcataa

SEQ ID NO: 809 - DNA, 199 bp, Setaria italica
tgctatagcgcgcgcctacctggcagagcttcgggttatgctaaaatggcttcagctctgactccaccggtgaaatggtatttctagtggcaaaataaattctcctgcacttctcgatggctgatgctctgccgtctgcatgtatgtttgatgttctgtttgcatgattgcatccacttcattttcttcctttcttttt

SEQ ID NO: 810 - DNA, 2792 bp, Setaria italica
cagaactttaatcatctcttaaaaaagttattgcttcaacagttacagtatacaggcccaggataatctcgtgccgacgactactgatcgttcggctagtttgttccggacggatacgaaaaggatatatttttgtaatcgactgcaacagatttataaggaattaagtggtatgtttatattcttttgttcacaacctaagcaattgttcgagatgttcaatgtcttgttcgtaatgtacaattatctattcataatgttcaatatttgtttacaatatattatcatttgtgtatttgtgtgtcgtgtttaatctttttgaattcgaacgatcctcatatatgacggataaactaattaatttaaaaatgaacgagttagcttgtctaattagttcaaaaggaattagttagttgtcctaaacatgagaacgtacgtagtatttgttagcagtaataaaactaattacctttttatatttatatttttttacggaatatttattttgaagctagaacatttttctcctaaacctagaataatttataaaaattccaacttggtaaaaatatttttaaaaatagtatccaaacataaagatcttgttgtagcttgaatgcttgatacgatttgtaacttaatttgggatgcttgatttgatattatggcctttttttagtttcaaattttcttcgcatgtggggtggggtgggatgatgtcactggtttgctttttgttgcatgtgcgcacttgatcaattgctacatgcattatgggccgcaaaagaaaacagaacagccataagtggtctaatatgataaccagactcagcgtggggtttctcaggcgataaaacaagatttattgttgaagcaatacctaatcacaatccataaggggtcaatgccctcctcccctgttgaagagcatcgatcgtccggctaatttggttccagatagatatgaaaatgatatgcgacgtatttacaacaaattaaatgattcttgaaccttattgatattcacatgtaagtaggatgtttcgtgccggtgatgcactcttgagcgtttgcacgtatatttcggggtttactatgagcaaaggaagaaccatgttaaaccccacattgtattttgaattatagctaatctattaaggagttgagaaataacacgtatacaattggagatgtactaaatgcatgattggtcatccacgaagctagaaaaattaacatgagaggtgtttcaaaatcaaaatttagattattgcatggggggctagcttttgcccccctccctccactggcggggaaaagttgtacgttcttgctccaaatccaaccccatgtaactaatcctgatggatatgacatgatcatttcgctaaccccaagcatccctatgatttctcaatcctaccatatatatggttgctgaatgagaaagtaaaggaatattgagattgttgcgatagcacagcacgtggcaccatcgaggtggaacttcattggggttaggtctgtaggacagtgggaaggatgcatgtagttctttttccagtggcgtcgcccctgtacacggtgcaccaagccagcctagatgagagtggtgaccctagacgaccattacttggttgtgctgtttgcaagcaaggactgagactttttggttggttggtcccccgagcctgctgggctaagcccggaccatagctcaatggttttttttttttggctgtagtgatgattttggctgcgtgaaaaaattaggcgggctcggtccagccttataacatcccgaaaattccggtctaatgctttttgtgggtatgtatggccgtatgggctcaatttttcggcccaaaatgttttgagtttttcctcggtttcaatttctgaaccggtctgattttggtgattatatacagtaaagtcaacttataatttgacgtgcacctctttgtacgttttcctttgcatcttttcgaagtaggccaaaagctgctattatgtctgatacttttagtgagcagaaaatttggaagaaattatggttcatcaaagcctcgaataaaatgaaaatattttttgtgatgccttgttcatgattgcttgaccgtgggacatcagctacaaagacgtcatattccagataatcctacatgttgtttctgtggccgagatgaagagattgagcattgttttttaatgtacccttttgctacatctacgaaatgctaaaccatagttatattgacttgttgagtcattgcaccaagatactgtgtgtagaagtagttcccacatgttggtacacccgggatgctcataatgaaattactaactctgaaactagtgtgtccttaggtgatagtcaagaagattcaagctcatgtgaatatgattatgttgaattgtacgaagccaattcagcctttaaggtgtggagttccgaaggaaattaagaaattgactccatcgcgagttggtttggtttcccttaatgctgatgcaacaattttcccttcttcatcaagttcgactattggtgtggtggtgcggaaccatttggatagatgtgtgatgagatgatgtcagtttttccatggcattactatatcataagttgtagaagcactagctctccgatgtgctgtgactctggcttacacaaagtgattttccaatccgattacttttcctttttgatggcaatccgattactttctctggtcaaaaggtgaatgctcttgataaagatcgatcttccacgagttctcgttgctggt

SEQ ID NO: 811 - DNA, 173 bp, Setaria italica
aggctcgatggtagggcacagattctgccgtcagtggtggcgaggggacagattgtactaaatactaatgccctatgattaacatattcgtcgagaatggaacatcaacccgtattcagtgcatcactttggaaagggagcagaaaggttgtaggccagaggggtaagatcga

SEQ ID NO: 812 - DNA, 132 bp, Setaria italica
tagataaagaagatgagttagattctgtggactaattttttcttagagataccatatatgtacttccttgattttgattattgttgctgttgctttaacacaagctgatgacaaaaaaaaaatactgtacca

SEQ ID NO: 813 - DNA, 304 bp, Setaria italica
gtaaaatgcgttgaaatgtgatgtttttaccttggtaaacagctttgtttagataaagaagatgagttagattctgtggactaattttttcttagagataccatatatgtacttccttgattttgattattgttgctgttgctttaacacaagctgatgcaaaaaaaaaaatactgtaccagaaattcagaacctgaatcctgagcgcaccaaaaaaattattggccctgattgttatcattgcttagaagcccattttatgcttttcatatcttcataggaaaagcatatttttgtacatgat

SEQ ID NO: 814 - DNA, 582 bp, Setaria italica
tctggatacttgtgtacatccgtagtggtggtctagtctggcatggaagcatgtgcgttccatttgtgtgtttgtgtttttgatcagaaattcaggaacctttacagtgtggaactgtagattggcatgcctgtctgctttctacttttgcagattgacatggaactctcagtcacaattcttcggaaaatactacatggtcacttaaacatattaatttccctcatattccaaaattcatcaacttgtattgcaagaaaagctgttgagcagggccatcactggacgtttcaccccagtttacttcaattcgttgataaaagtttgaagatcagtctcctcggttagtttgttattttcgtatgaattaatctagaaagattttgaaccttaactttttcgaccaaaatatgaaccatggatatgccaagtttaatttgttttcggaagttaaaagttcgcttttgaataatttttcaccattttttcgctcgttttcccattttcaacatagctttcgcatagctcggctgcgactccctatcaacaaagtgcagaattattgtaatgtggacaccggtg

SEQ ID NO: 815 - DNA, 257 bp, Setaria italica
gaagaagttgccgataactttgttgcaccgtgactccattgtgcgtgcagtgtgtagccgtgaccctaagcttttccgtcagtaaactgtgaataagcagctggtaaaggactgtgcaccagctcacctcagtatttggttcagaatctcagcttgcctatgtactacatttgggtgtgacttgtgagtatgaatttcaacaagatgtacaaatcacaaaagttatcaaagtttatgtgaagtgtggcatacatgta

SEQ ID NO: 816 - DNA, 180 bp, Setaria italica
gagcgcgaataacaccacgcacgtctcgctgagtcctagacgtgatatgtagtaagaaaaatctgtccctgtgtaaggtggcaggttttttttaagtaactttgagtcgcatcccgccgaattgtcatccatcagcaaccaccgccgaattgtaatcgctttaatttcaataaaagcagg

SEQ ID NO: 817 - DNA, 1259 bp, Setaria italica
tgcaaataattccaacaaataaacagtgtgtcgcccagtgccagatgcccatgtccacatgcaccatattctttgtacaagtttgtgatttgagctactagctactgttcgtttggtgtttatttgtatttggaagtattgccttgatttcagtcaccgtgatgattttttaatgtaccttgggccaaagtgacaaccagtcacattttactcaaaaaaaaaaaaagataagcagtcacattgaccatttcattttttgaactatataccctccatcatattcgcattacctcatgcgaaatccaacagttactcatgcaatcgctgcgccgtttaggcacgaatatgttgtatataaatacagatatatataaaatattgtaggacgaattttaattgattatattcactacacattctccataatattgcactttcctgtgactgtattattaagtatatattttcaatttataccctaatcgatacattcctttgttgagagaaagggtcatcgtagcacttcgttccagtttcacgctgttagtttcaaaatctaacgtataggaaaatctataagagaaaaaataatcaagggcttatttgtttaagcttcctggtagctttttagtgtaaaaagttggaagttcaaacaaacagcaaacttctcgtgcagcttagaaaagctaactttatatgaaaagctggaaagcttcattttatgagcttttcgtagctttccgagctcagaaaactaacacacatattctaaaagctagtgttagtttttcagaatcaaaaaatccaacagcagcttttctgaaaggctcaaaagctacagctcaaacaaacatgtcctaataatttaggatagagagagtgtatgttagcgatccccatcaaatctagctgttggctttcaacgtgcggatttatttaataaaaaaatattttagttccatatgtgtcgatgatatcgttgtagctgagttctgcactcaatctttcgtgtactcaatcattcttgttgatcgactccgcagggcagacaggtatataaccaacagaaaaatattcagggttttattttagagaatggacttatgctgagttgtttgtcctgtcatggaatcatcaaccatagttggtattccaggcgcgtgagtgctgctgcaatctatcgtttgggcgtgttcctcgtgcatggtttcttcggacccaggtaatgcagtggaagcgtaaccttgagccttgggcag

SEQ ID NO: 818 - DNA, 291 bp, Setaria italica
agggatcaaacgcatcgcagctgtgctgaatcgcactctcgactattccattcgtccaagaataagtctgcagctccgtgtttcgtggtctgatcgaatgcttgttgtgtgctttctgcttccttaattgtgtccgcaggccggtgtccaggccggcctatttagctcagtcgtcgagtgctatgtcagcagtgtgcccagtgctgctttatcgtgctccagcctcagagctttcggctgtagcattcatttaattgctatatacatgtcagtggtgattgtcgtttcgta

SEQ ID NO: 819 - DNA, 116 bp, Setaria italica
tccgttcaattggcactcgtgttcggatcatcattccagtttgttcatcgcctttctgtctacacgtcaatgtttgtgttgacggtcttgtgctttgcagcttcattacatcggca

SEQ ID NO: 820 - DNA, 582 bp, Setaria italica
cctgataagcttgaagtattcaagaagtgatatgacaagcaataaggattagtgcagatccctgctaagataaggtttctgcttctcagtcatcatttgatatggttacaactctagttgtaacccaagtgtgcataggtgcaccgttttctgttatggaataaatgacaaattatatgagggtgacggattctgttcacattcacagttaagaaaaaagctcaagctaaatttgtttcaggcacaagaagtagcatttgaaatgcccaaacaacgtgcagcactttaacaattgaatggaaaaagagcgcaactaaaggaatcatgcttcatgggaaatcagaattgcataatacctccatgttaggcagccaacataaatacccaatctcagattgggattcaaattctttacagggcaaaataaaacaaattattagtacacccacctgcaccgaaaggaaaaggcaacataacttgaacatgtaacaactaaaacaggagtgctagaagacaagactggatacctagtatcagcaaactcgtgccatgatcacagtttcagttatttatggttccaac

SEQ ID NO: 821 - DNA, 816 bp, Setaria italica
ctacgacgacacaacgttgcacgacgactcccacaagttaccacttgcagttaataattaaccgctcatgttgcagctagcatctttatttacatttgtttcttcagacgcacgttgtttgattctttctttgcatgcattcagatgaacattaggatggtttctcctttttgtgttgcaatttcaagatgttgtactattggattagggatcagttgatgcaataaagctccgttgttttttttggctgaacctgaatgttcccttttgatattgtgatttttttatgggtggattttccaagacctgcacactagctagtgagtagggacctttgtattgcaattgcaagatgttgtaccgaattagagatcggatgatgcaacaaacctcctttctcttggctgaacctgaatgttgcctttttgagattgtgaattttgatgtaggggtggattttcaagacctgcacgctagtttgtcgtcagttggaataacacatgctgagaggatgagtcaattgcaagcgactctaatcctcactaaaatttatgtggctgccaacaaatagcagtagtagtacgggcatcgtttggtggggcttcagattaccgatacaattcacgctataactggaatctgtaggctaaacaaaatgaactagatagtactccttccgtttttatttataagacgcacacgtatatcaaaatacaaactttacaattttttatcaataatttgactattaattttttattttataatataaattttatactctacggtgattataagtttacaaccataaataat

SEQ ID NO: 822 - DNA, 193 bp, Setaria italica
gggtcatccgtggtagctccatctttgcttttctgggtgtctcgtgtttcattctcgttttgccttcggtaaaaagtgtgcagaaacagattgcaattgtgttttattgctgttttcgggtggtatgttttcacatgtgtaatttgccattgttgtaccaagaaatcattcaataaatgccaattgtttgtgt

SEQ ID NO: 823 - DNA, 235 bp, Setaria italica
gaaggttgacgtacttgttgcagcaatggaggttgaagaagaggccgttgcgtgcccagccaacacacacgttcatagatcaagttgagccttaagcttggtttttgttgttccatccattcttttgattcgcattggttgtactacactttgttgtccatttttcatctcagccaatctgttacatactatacatgtcttaaggaaataaattatgtatatgtatgttcctgac

SEQ ID NO: 824 - DNA, 284 bp, Setaria italica
taggatggcggcctcgctcgtcaggctgcatttccatgactgctttgtccagggatgcgacgcctctatactgctggacaacagcaccggcatcgtgagcgagaaagggtccaaccccaacaggaactccgccagaggattcgaggtgatcgacgagatcaaggtcgccctggagcacgcctgccccggcaccgtctcctgcgccgacatcctcgccctcgccgcccgcgactccaccctccttgttggcggcccctactgggacgtgccgctggggcggcggg

SEQ ID NO: 825 - DNA, 1690 bp, Setaria italica
caccctggcaagcgcccccatgctcttccgtatattcctcagagtgcgcatggccaagctacgaggaaggacactgctggttcaggtggcttaagtttcagacatacagctgcagcaacctcctgatgaactgatgaacgtgcaggcacaggtctgtgatctgaagggtgagattaggagtataatggcaacagagcgccctgcatcaaagggacagaatgatgtcaggccttcctctttttgcttttgctttggtccgtgaggctgtaaattggtaggtgaagtggctgattgttaactgatgatgttgtagcaccagattgtaaccatcgaacatggcctcattaagttatagtttgtgattttggtaattgagtgataatataatgttgacgtcagattttgacacgtataggatcggcgtcaagggaggaaagaattggccgatacggtggattaaaaggttacgattgggaatcggccgattggtgctacagttgggaatcggccgattggcgctgcaagtgttttggcagacggagttggtggagatcggccgattggaaggctggaacgattgggccaatgtgggcttaaagtgggtcagagaaagaagatagagaaagattggcccgtgggagtacaataaccaactccgatacgagttgtgtttgtaaatattcgttttcgtttaaaattagagatagatcctagtcggttaggaaagcggttgtaacaggctataaatagctatcttcagagatttgtaaataacacatcaatcaatacaaacaaatctattttttcatcgtactttaccttcaagtcgacgacttcgccaatacttctttctttcacgagttcgtacgggttggcaggattgcatcgacaatacttctttctagttttatcaccagttatccagcttgagattggaactgtcggctttatcactgttcttttatcaatcatcgcatagccgattagatctatttcaagtgttgcctttgtacctttgtctagtttactctagtagtttttttcgcaatcactacgtgattgtcggctgtatcatagccgatcatccttatatagcaaatcggccgatttgctgatacgcttttcgagacagatcggaaccttagctgatcggagcccctggaacttgacacgttttcttccttgccaatcaacaggttagattggctggcacgccgcgtgaaccgcaccagtgcgatcacctgaacaggagctaagcagattctctcgggtcgtgtgtccgacgttgagggtcaatcggctgacttttagtgccaacacacttttggcatgcccagtgggaccacctcaacatccagcatgtcaaaggccgccgaagtctccgaagacaatgtcatcgaggttacggaggcagatctcaaggatgaccagaaataagaattggcaaaacacctagaagactacaagaaggtatacctgcaatctttcagtcgtaccaggagcagggaggccatcaaaaaagctcctcttccaactccccgccagatcactattgctgagaactcgggcaagatgtccgacatgattcaacagtccgtttatcaggctttcatcgaccaatcaccggtgatgaccaacacggtgtacaatgccatcatcagttccctggccaacgaggtagctcatggat

SEQ ID NO: 826 - DNA, 303 bp, Setaria italica
tgaatccatgcgcaggactcagggagttgaggctagccgttgtgctcgcgtttgctgaagaataaagagtcccttatttcctctacttttcgaaatgcttcatcaatagtgtcctcgtcacatgtttccacaacaagtcaataaacacatctgtgcactggcgttgttgttatcattttttccttaattaattttgagaaattccctgtttcgattttgctgaattgcatgcacgcaagcactgtaattcaatctctgaccttaagtattgtttcgttctatctggttgctgtcaatgtttca

SEQ ID NO: 827 - DNA, 448 bp, Setaria italica
  misc_feature (1)..(448): n=a, c, g or t.
  unsure (1)..(448): unsure at all n locations
tctcatctgggtgatccgatcaccatgcatgcaatctcctgtccatcagttcacttcagaatcagggggcgtccaaagaataaaatccagctattaattagctgcatgctaggtcttctcgatccatcttcgttccacgtccatccaaccatgagtgtgtttattttattacgattaaattacgacatagaagaatgggcatatacaagaatgggcatatcaactacattgttgtctgaaaatcattaagttattgtaagcattctagcgtgttggatggattaatgttgtctgaaaatcattcaagttattgtaaccattctagcgtgttggatggactggtcatgaaataaccgaccgtaagagtatgtattgtaatctttctgtttcttggtcaaggaagaaaatatatgtagttattgttactaaaaaaaaaaactaaaagnga

SEQ ID NO: 828 - DNA, 120 bp, Setaria italica
gcgtcgtgacacgcacgcatgatttgttatttttttgcagagaattaattaattattatatcctgcggcgcaccgacggttgttgatgaacaagtttacagatgtttttttttcttttgg

SEQ ID NO: 829 - DNA, 138 bp, Setaria italica
tatgttttccttcttctcagtcaacctagctatatggtggagtcaaacttcgtattttcatttttttactcctgttacttgttaaacttgttttttgtccgaagtcatatgtgtaataagactcaccatgtttgaagg

SEQ ID NO: 830 - DNA, 226 bp, Setaria italica
caagtactttcgtgcacggcctgatacacgaggctatgttatgctacctgatgttgttttcaccaagtccctttggtgttggcaaagcaatggcggcatttgtgagttgcgcatatgagggggtgatactcttgtatgttagtgtggttgtgttgtcgcatcaagaagtgagaaataatgcagtgtatgaataaattgttaaatgaaaatgcaactatgtttctgg

SEQ ID NO: 831 - DNA, 305 bp, Setaria italica
gactacagcagtcctaaatgaagaatatgcttatagtgtggttcagtacggaccgtatgctgtgagcagataaataaacgaagtgccttgttccctgaacagaggtatatgaatcttaaggtagatgaactaagcttttattactttgagatccatatagcttctgttttagaaactagcactattatgcttcctttgtgccatattcctatgtttgctccaccgagagacagtttggtgcttgttgatcagtatttgatgtaattccaaaataagatgtgtaatgtattgtcatgttaacatac

SEQ ID NO: 832 - DNA, 228 bp, Setaria italica
gtccgatggattgaaccgatcgatcgagtgcagcgtttcaatcttcgtcgtcgtttgctttgctcttcgacacgtgacatggtcacgaatttgtatttacaaatgatgtgccattcatggttcttgtgttcatttcccttcctttttttttgtttaaatcgatgtaaagatctcatccgatctgcggttctcgtctttcaaggaaaaaaagtgtgttttactttttaa

SEQ ID NO: 833 - DNA, 232 bp, Setaria italica
cctatacgcacggttactagacagtgcgccacgctccggatcaaggctgtataccctcgtgtcttttcgttttgaataaacgggaacaataatgtacgaaagtagtgatgcaaggaaaaaaattacaaaaaaatgtattcactgcacgtagttagtgaccatttcacttcactgttaaccagggatagatgcaaggtcctagaagagtaccaactggcacccactagttgac

SEQ ID NO: 834 - DNA, 117 bp, Setaria italica
tcaggagggcgctgcttgaccgttttatttgtggagagtgttggatttgtatgttggtgttgatgttgatgacatgttttgattgaataatcatgaacggcttgacgcccgattaag

SEQ ID NO: 835 - DNA, 264 bp, Setaria italica
tggagaagatgatccgtgtgcatgcccgtgagtctgtatcactgtatgtgtttgagtgatagagactcagtaaataaggagctgtccagacacccaccagtgtgatgtatcatatcatgtttgtgtgaaacaccagctttgtgatgctgtggactgtgtgtggttggagaaccatgtggctacaccaagcttctgttcacccaatcagtgtggtttgtgccgtaatggtgtgctgttcagtggaatataatctggtttccttgt

SEQ ID NO: 836 - DNA, 192 bp, Setaria italica
  unsure (1)..(192): unsure at all n locations
ctcctccgaacctgatcaccatcggctgcaacaagctcaatttcactcttcttatgcatgtatgtcatgatttgcatcgccattgtttcgttccatttgctatggtgaactttaatttgtgtaggtttgtatcatgattggatcgagttggtaataatgttaataaagtcgatcggtgtttcntctacaaaa

SEQ ID NO: 837 - DNA, 263 bp, Setaria italica
agatgagggcatgcacacacacatgccttcctataatatggtctgctacaagtaaataagaagccatctgatgcaatggcttggctgcttgatggtctccctctcctgttactgtgcactactgtgacttgtgaatcacagtatcatgtggccttgtgattgggaatggaaaatatgaggtttccaagctactagtattatccttgtatctgcatgtgttgtactgtttcagtgaagtaaatataaatccagtttgcttgtga

SEQ ID NO: 838 - DNA, 231 bp, Setaria italica
catgttattgcctggtcaatctaagtgtggagcccaacttttcttgtttcacgttgtaattttctgctttgtagtcgtatcattatttagtagacgcaaattaataaagggctccacttctctatagtcaatgtagagtctaagtgtaaggtgcaagctatgatgaggagacgctgtaaccatgtcaacatttgaatggaatagtattccattttctcatgtaatcttttg

SEQ ID NO: 839 - DNA, 314 bp, Setaria italica
gatttctcctggacattcttatattgcggttgggcaccataaacctatagtgaataaataaaaagagtgccataattttcgaactatcgtttcatggaacatgatcaagcagcttgctgaggttacaaagctggtgtgcttcatgatctgtatactttcatttcgaaacgtatatctacaatctacaacttgctcatatattgtatgtgtatggtattgatatccaccaactggagttggatgtgtgtaatgcccctgtttgcccctgtttctcagaaaagcaaccattgtacactacgggaaatataatatgc

SEQ ID NO: 840 - DNA, 167 bp, Setaria italica
ctgtatcgactcaatctaaagttggagcccatcctcctttcttgtttcaagtctgtacttgtgttatgcttttgttagaatcaaattaataaagggtgtccaactggagcagtataatctaagttgtaaccatgcaagtttatcaataaaataattactcctttttt

SEQ ID NO: 841 - DNA, 418 bp, Setaria italica
taagggatgaagtggttcctctgacgttattaacacgacgtgatgtggttgctacatgtcagtgatcattcatcactgacatagcgtcaggggtccatcgtcgcagcgtaaggggggcggcataatgcatgtctatgtaatgtatcagtcgtcgttcatcggctaataccaccttgcatgttctctactctagctacatctccacagtgcctagctgctagtagtgcagcgtcgttgtaaacttaggcactgtttgtttggactttcaagtagctttccaccctaagaagccgaaagctcaaacaaatggtcagtttctgggctgagctttccgaaagccaaaagcccagaagctgcgaaatgtgagttttctgcagcttttctatgtcaaggtcgcgaaaattaccctcctaaccaa

SEQ ID NO: 842 - DNA, 527 bp, Setaria italica
gtcacacgcctacgtgtaatcgtgtatacgccgcagcacgccctggcggcaacgggtgtgtgaactcggaacggaacggcacgggcgcggcagcaaccgccgggaactacccagcagtcgccgtttcactctacgggcgcgccctctccctggctataaaatccggaacgctctgcaggaccagtgccggagaatctgagcgcgcactacactaaacttgtgccgccatggcgtccagcctcctggccaaactgaagcgctgcgtgtcgccgccgtccctccgctcctacttcgccgagttcatctccaccttcctcttcgtgttcgctgccgtcggctccgccatctccgcccgtacgctgagttttctcttccaccgcgcgcgcgctttgatggttctcgcacgttacattctttgcattgcgggcggttgcattgacgagagcgcgcctgtgtttggcaatgtgtggcagggatggtgacggcgctcgacggcggcaccgcctccgacgcggcgtccctggtgg

SEQ ID NO: 843 - DNA, 1742 bp, Setaria italica
  misc_feature (106)..(108): r= g or a; w= a or t.
ataagaatgtaagagtgctaattgtgtgcaatggttacttttgtgttgatcttgttaactgatatacatgcagcagtgcaccccggctctgtcctgttacgaaaarawagttatttgggtacatgttattttgctggtagagaaaccttgtaaactcaagacattgggtgtgcagtttcgctacatataatcggggctcgtccctggtttctaaaaaacaagtaataacttcatgccctcgaattattcatggaaatatttataagcgcctttgtgaggtttcttccttccacatttttagttgaaacatgtgattacttgcatcccaaaatttcatggcttgatctgtgaatgtccaaaagatcttagaaggcatggttttatatcttcttagaggaaaataactggcgtaaataaagaaataaagataatgcagattttgaccaatatagggtgtaattttaggagaaagtcctaaatgtagacattgacctttccaatgcatcatcaattgctataaaatcaacataaccaaaaggtaggttcgggtacggtccattattagaaactagcatatatatacccatacgttgcaaacttgcaatgggagaaggaaaaaaatcatcaaaatggtctattttttttaaatactttgtgaaaggagctaaatttaaaaccttccacctcatttgaaagcctcaatttccttttaaatgcctagtcgccacaacctttctagttgatcgatcaatttgtactgtactctatggcctaattaccttatcctcatcttcttgacttcttcgttcttcctagccacgatctttttcttcctcgctgggatttcctctattggccgcccctacccttccatagctatgcataattaaaggtaaaaaaatatacttaatttacaaggacaactattacaagaggacatataaaaatatctctcttttttctacaattatcacaagaatgacgcactgttaccatttcttttacaagaatgagcagatggaaaacaatcggttttggcgttgagatcttaggccgtcccgtagcataatttcattgcactgtaccaatattaagaatttgttaactgtgcttgctaggtgttatggggatgaaactaatctcttatatgatgaaacttcctttcataatgaccttggtaaatcagcaaagttacagatatagcaacaaatttaatgctcatgaaattccaatgaaacacctattgagattggccttgatcatctagagtttgaatggtttgctatcaaaattttgacctaattatttttctactatttggtttgttaccaatatttactgacctatcatatttctatttctgtaaagatgaagacaattgagaatctttctcacctaagggtgctaaagtttagctttatcacatcggatgtttagatactaattagaaggactaaacatgaactaattataaaactaattgcagaacccctaggctaattcacgagatgaatctattaagcctaattaatccattattagcaaatggttactgtagcaccacgttgtcaaatcatggactaataggcttaatagattcgtctcatgaattagactccatctatgtaattagtgttataattagactatattcaatacacctaattggtacctaaggggtgtttggatccccgggctaaattttagcccctgtcacatcgaatgtttggacactaattagg

SEQ ID NO: 844 - DNA, 182 bp, Setaria italica
gcgctgaccgtcgcgttcgtctccggcatggcatgagcaagccgagcatgccgacgtgttctttgatttgcttgtcatacgcgtgtagccggtttgaccagcttttgcttttcggtgtttcctgtttaagttgctcgtcctctgtgtggacgtgtcctcgaacaatttggatcactattctc

SEQ ID NO: 845 - DNA, 292 bp, Setaria italica
atcgacagcctctcccgccggacaaccggaggcgtgaactgtagatatatcagcggccggcctcccccactgcaaatctcctgaatgctacgtgtgcatcgttggtagcttccctgctagtgggatcatgcatgcttaattatgatctgcgtgcctcctgtattttccgagtccactgcgtctgattacctttttttcttcttccaaactagtgtgattgtgctgttttacatatcagtgtacgtaagacaacttgaaaaatgaaaaagaaaaaggaagaagtgtgtgatgt

SEQ ID NO: 846 - DNA, 440 bp, Setaria italica
gatttctcctggacattcttatattgcggttgggcaccataaacctatagtgaataaataaaaagagtgccataattttcgaactatcgtttcatggaacatgatcaagcagcttgctgaggttacaaagctggtttgcttcatgatctgtatactttcatttcgaaaagtatatctacaatctacaacttgctcatatattgtatgtctatggtattgatatccaccaactggagttggatgtgtgtaatgcccctgtttgcccctgtttctcagaaaagcaaccattgtacactacgggaaatataatatgcataatggttgctctcccaccttcatgaggacagcctattggatgactcgcatcgggtgccatcaaagaacccatcaactactatattcatggactggaaggaaatgaggcaatcatctagaactaa

SEQ ID NO: 847 - DNA, 348 bp, Setaria italica
accggcggcgccaaataaaaagcttaaatacctgtccgtctcagttcaacaccgcttgattatctccatttttccccatctgaacgcttctgtaactattgggcgagcatgcgtgcccatgagcaatgctaccattggcttgctaaacatgtgaatgcatggtacatagctccggctatacctttgcacatagtgatatatttacacgaatgtatacacagcgatcatattcatacgacaatgtaccactagattgccaattcgttggaacattataacatggttgttttacttacgtaaatgatcatatgataatacaaggaaaaagtgtatttttcatccctacaa

SEQ ID NO: 848 - DNA, 493 bp, Setaria italica
gttcctggagcagtatatctgtacttgtattttgagatgcaagatttgaaggtcccgtggcttctccatcattcttggttctttctgaatccttgaagggctgttagccatggagcattgtgaatggtggtaaagtcgtactacatgaaatacttcagcagtctaggtcgtcaggtcagtcttttttttcccgacaacagcaccgcgtcagggccttcctgttgtatgcagttgatctgggttttccaagacgcaagggtgtcggcagctgttgcccttgcagtttgagtctttgagagctttgagttggtttcagcacttcagtacatggagccgagtttgcattttgtaaccaaccgccccggcgtgggtgttgatgatttgtgcttgtaggttcttttttttctcttttcttgagacagatgttactgtttgtggaggaacaaattgtttattcttaaaatgttttacatactgctatgattgaagaaca

SEQ ID NO: 849 - DNA, 210 bp, Setaria italica
gtgtcgtcaatgtatgggtttgccgcgggacgggtggaagtctgaactctgatggtgcaggttgtttcgtgttcagggagtcttttgagccctgaatccgtggtgtcgtgtctttttagctttgttttgagtcctgagatgagacacctttgcaagtgatgtggttttaaaccttggttaaatcattttgcaaataatctttcgtagcaa

SEQ ID NO: 850 - DNA, 226 bp, Setaria italica
atctttctcttaggcttgtagaatttccaggagactttactgggggactttgctattttctctaccaccaattttttgtgcaactattgaggattaaggtgttaaatccccattgtcttgtgcgagatgttttcgttcttgatatcgaacctatggtaatatcttatttcaacatttttgtcgctgcctaagctcaattcctgtggcgtaaagaacgtaacgtaac

SEQ ID NO: 851 - DNA, 296 bp, Setaria italica
acgatgcttcctgctgctgtgtcaggcctgtgtgccgcggttatcctatgatctgcccgagtggctcctatcttatcttgttgtgtgtcggtgtgtcggtttgaactgttatctgtcgtcgtatgtcgtttacaacatcttatgttgtaagaaacttgtttaatcctgcttcgtttctggattaataatcctgttatgtttcgtgtctgtttggtgtcgatctactattgtctgcttcgtcttcgtctgtttacaatttgggagtacgtctgctatggcaacgctcgcaataggtt

SEQ ID NO: 852 - DNA, 204 bp, Setaria italica
gtagctggttaataagtagttcgctggtggttaatggttgggttgttgggtatactctgtatggttccattccattgcgtactgctgccgtgtgtgtttccattttgtattatgtggtataaattgttcgtagcgcctggttggccatgattgttcatatcgtcttgctttggtttgcaatgctattcgacgaatttcggtgta

SEQ ID NO: 853 - DNA, 247 bp, Setaria italica
tcgtgatcggcttgcaggtatcggttgtgtcgtcaatctgtggatgacatctgtcgcggtgtcgaaaactcttttgatattgcctcttgggctgtttgttatgttggtgtttgcttcaccgtagcttgttgaactgctttaataccatgttgtaatggaatcagtatctcggttaattactgttggttccatctcgtgctactctcgcttaatcagtacttgcattttacgttacgtcccgcgtcct

SEQ ID NO: 854 - DNA, 96 bp, Setaria italica
actattccggccatcattcttcatcatactagtaaaagaagatcataggtcttttgttgtttccagcttcaagtggcaatcataccacttgggctt

SEQ ID NO: 855 - DNA, 487 bp, Setaria italica
agatgatccatgtgcccagaaactacatttcagtgttcgtctactagtgaatctgccaatgtgctatgggttcttgtttcgttggtataggctgtattgttgcttgtgatagctggaaattggagactcccatttgtgtcgtgctagaaaggcttgcgagtagcttgctggttggcaggtgttgtcaagctacacttggttgagggagggagcctttatttatttggattattggtgttactttgtatttgtaggttgagtcctgttgctcgtctccatgttcgtctcttttctattgttgattttgatgtatttccgtaaatgcgcatgatgctctgaactgaattagtttttgccgtctgattgtgatgctggatgttgggagtgaccttcgccctctgtaacctgcaaccacttcctttctcctaggacggcaacaaattttcttttaaaaagacgaatacaagtcttgaagctattgtctgaa

SEQ ID NO: 856 - DNA, 180 bp, Setaria italica
tggggctcatcgtggatgacgacgacaatggtgctggcaacctttatgtatgatgtatggctgtatgcatgatgctagtctggttcttgctatgtttaagggtcattttaggttatgactttcttttccttaagtgtcacttcatttggtggtcatcaataatgagcacttctagcattt

SEQ ID NO: 857 - DNA, 257 bp, Setaria italica
gctactggagctaactcagctggcttcagcctgcgtgtcattttgttttggaccatggtgtaacattgcaaagtaatggatctatgggcttgagataggcttgtcatcgagttttgctagatgagtcgtgaataagctttgacttcctcgctgctgagtgaagtgaccggaatttgaaaaattggagctaataaactcccatggatgtgtatgatattttattttgcagttgagcatctctgtttctgttgcaaaca

SEQ ID NO: 858 - DNA, 284 bp, Setaria italica
cgctctagctagatttagttcatgatgaggagaaaaagcaaggcacaaattttcgtgtaaggtggtcggcagctaaatggacttggcgacctctgatactgtctcacttaagaacttagaaatggttcacatgatacaactgttttttaccttgcggattatttggttcggagagttgaagatgagggaaaagattatgtgacttgcgcgatgtcctgacctactgttttccttactgacttccatctcttggtttaaggattcaccagaattctgatttggcc

SEQ ID NO: 859 - DNA, 227 bp, Setaria italica
gtcatctcatctggaagcatgcttattttccttaggtatcagtcaactaagactaagagtgcttggatggcattgttgtcctgccatttctttccctgtttgttattgcattgcaactgttcatggttggcagagtaaaagtgtaaagttggttgaactggtacgatggcttcatataaaataaaatctatatctgtaataagtatttagttattagtttggtacca

SEQ ID NO: 860 - DNA, 233 bp, Setaria italica
tgtgccaagagaattatttgttagttctagtaaatgtttctttacccacttcctgttaagaaaggtgtcattagtgggtggagaaaagcaataagcttattatgttcccccgcaaaacgaataaatctgggaactgtggatgttcccttttttggtatcctagaagtatgtaaatgtattgttagattgtcatctttctgattggatgtctatagactactttaattcttgct

SEQ ID NO: 861 - DNA, 135 bp, Setaria italica
  unsure (1)..(135): unsure at all n locations
gcgctgtagcaagatttggttgacggtggcggcaaatttgttgtttcgctatgtgcgagtatgcgagtagtactgttggggtcctaagttttcccgcgtattatgtggtactttcggttataaaaatanaatatt

SEQ ID NO: 862 - DNA, 659 bp, Setaria italica
tgatacacctcactgattgactgattatgttcccacatcgcgatcttgtacatttatttcttttctgatacataccacaccacatcaaaagatgacctctgtaaaatgtatcacatttcaagccaaaaggcatgacaccaggtataacaaaacaccatctgccccaagtacgactaaatttgtggttgtaggaccagctagaagtaaaatttggtgggagaaatctcaggacggctggcccggcccctccgcctcagctcagcggcatgtctttcgtgctgaatgcaaagaaacacaagtcaagtactgtgaactgatggatgaacattggttgtattgaagggatcagaaggactcgcccatggattgaagggcccacatcccaattttttaccgagcaaatgcacgagacatttcgtgggtgaatgaccatggactactatgccataaatgatttgcacaagcaccttgacttttgggcactagtgggcatgattgctaccaactagcacaaagggtctagtggctagtggccaccccgttaaaacccgtcactacaatgcatttgtgctggcgagtgtttatgtcaccacaaatgcatttcaatttatattgatgggagggctaaatgtttctaactagccaaaaacttaatcgta

SEQ ID NO: 863 - DNA, 241 bp, Setaria italica
ggagcgtggagcatgcggctcttgtatttgaatttggaaaaaaacaatgtggaattataaaagtgtatgttgatttgagttgagcgtggggttaggtttgtaaacatacaagaacgaaatttggtggttggttggttggagatgtatgtagctgacatgtatgtgttggagcttcgataggaagcaaaaaagtaaacctgatgttgattctttgcgttgggtcgggttaatttggcgttag

SEQ ID NO: 864 - DNA, 389 bp, Setaria italica
aaagtgcgctgactatcaaaaagaaataatggactttaggacctgatgtgtggcttatgtgaacccttgttcctgtttactatttcgtgctctgaagttggttaaatgattacactaggtgcaattcaggggctaccgaattttgcctggtggtggttttgaagagtgcaaagttgcgtgcatcttctctcgtgagaagaacagaacaaaatttgagcgcattactttagatccctatctattgcaatgtgtacagaagtaccagttgattatcgaaaaattggttgccaatgactatctagattggtttatgtgttcggttatcaattgttgaaaacttgcagagactctttgagagaactagaccaaaggacaacacaggggatagg

SEQ ID NO: 865 - DNA, 264 bp, Setaria italica
ggttgcttggcctttcggcaggtgcctagtttgccacttgacccagtttcgtctatctgcaacggagattaccatatgttccatgcgtgaaatagtgttcagcatccaggaatatgccaatctcgtttcttcttaaagctgtcttggattgtacaaatgctttgcattgcagttctagttatgtgtactgttttgcgataagcatgatctatctgcagataaaaagaagaattttgacatgtgccggcttgagcatcagttcat

SEQ ID NO: 866 - DNA, 312 bp, Setaria italica
gtgccaggaactgtgaagcagctagccactaccccatggagtatatatcagtagttcagcttatttagggagctcacgcctttgatttttctttgtgccatttgtatctttgtccatctgagtgttgtgtatgtcctttcggctgacattgcgttaagtctacaactactattgttgggtgaggaataaacatgttggggctggctactagggctggagccagctcggctcggtctggctagctagcctaactagccagctcagctcggctcgttaaccaaatgagaaaaattgttggatcggaatggctag

SEQ ID NO: 867 - DNA, 464 bp, Setaria italica
agctaagttttcattttgttttcaccttcatcttcgtggaccaatgtgaacttggtacattcttgcttgctcctcgtcagccgttcgacatgtaagagatcaatgctttatagagctactggaaattgtttgaataactacacaaataattacctgggtcataaactaaaccctaaagggcactagagcctatgtccggacctggtgcagtggtaaaactctccacttgtggctcagaggtcctggttccaaccaacctctttgcagaattttaaacaattttgcaagggtaaggctctctagttgcagaattttaaaagaattttgcaagggtaaggttatctagaaattcacttcccctgaccccaccttgtgtgggagctttcgcactggatacgccctttacttgggagcttttgtaccagcaggacctgctttactgagcaagggtgtgaattttgttt

SEQ ID NO: 868 - DNA, 262 bp, Setaria italica
aataaataccgccgccctcctccctccttaaaccctcctctctctctcttcctccggcggcctgcttctgcgatctgtgctgcggatctgcagaggctccgcgatcgggcgcagaccagcgggaccagttgacggttgcacttacctagagagaactgtttaggctttgggtcggatgtttatggaagagtttgcttgttacttctgtctatgttaaccaaccacaactcatgagtataacaggtcaacatagacagaagta

SEQ ID NO: 869 - DNA, 230 bp, Setaria italica
ggttgcatttacctggagattgaactgtttaggctttggattggatgtttatggaaagagtttgcttgtttcttatgtctatgttgacatgatataccctcgtgaactggttgaagtttgtgctatgttgagaattttgggctatcctgtgttccttgcatttgtatctttcgtaatctggttctgtttgcgtatttggctgaaaatgtgaatcaatcggactactagtg

SEQ ID NO: 870 - DNA, 252 bp, Setaria italica
gccactcattgctcctgctgtccacctgggatacatgtggtctattgctgagtgttctgaagcttagttgcgatacatacataggcatttcagttatctgtggttttattttatccccgaattcttgaggtgttactttctacttggttgtctgtctctggaatccctttaaacttaagtggatggtgtaattctggtttactcatcaatgtgaattgcaatatatatagattcgttgcattattcgattct

SEQ ID NO: 871 - DNA, 81 bp, Setaria italica
ccaatgatatgatggagaagaagattcagacgtgtggtttaggattagctgcagtgcaatgaattccttctcccttcctca

SEQ ID NO: 872 - DNA, 290 bp, Setaria italica
tgagagggttaagtaacggggagggcgcagggcatgaaggtgctgctgcagtcttcttccttttttccccctttttatgagaacagatatggtggagcgcgggtgctgtatagtggcttagtcagatagtttaggtctggctgtctggaaggctttgtatagtaaagccgaatggaatgctccatggctgttctgtgacggcacgctatatgaagttgaaacgttgcttgttacttattgaatatcctttgtggctgtttggtttgtgatgatgagcagatagccttaaa

SEQ ID NO: 873 - DNA, 56 bp, Setaria italica
gaagcaagaagatgtttaacgctctgtctgtctatcataagccataataaaccccc

SEQ ID NO: 874 - DNA, 390 bp, Setaria italica
gatggatccaagctcccgacctggtgcatccgctgatgtttgggagtgatccgagccaatgttcctggatttcgatagctatcccctagtatacgtacctccaacgtcgtcatcactggacgatgctgcattgttgctgtttaattacgtaccttagatgtttgttgttgcacgcttttgtttctgttttaagtccgataaaatgatggctggatgctggttttcatgctccaatctggccaccatggggaaaaacctgctctcatgttgcagtgttgttagaatgattgcatatgttacttgacgtatggagtatttgacaggcctgctgccaagtagtattttgttcagacgagggtaggaacacacaatacttgcaaagccatctca

SEQ ID NO: 875 - DNA, 264 bp, Setaria italica
ggatgcatcctgttggatagctgactgttttcatgtatcagattctgggtatcttgcttgaatatttgtcacacctactatgtattctagaaatcaaaatcaatagtttcaatgcagaacctggtgtttaggccacgattgcaaacaatcatgaaaaatgtcgaattttgctcgctaagttgtgatatattcactacattatctgcctatgatggtgcgttttcatcatttcattttttaaaatcactactctacttctgcttt

SEQ ID NO: 876 - DNA, 340 bp, Setaria italica
agaataaagttgtagggcttaaaaacctctctataagctttggatttctccatggtgctccttggcttccatggggggagcgtctcctaagttgtcaagtctataggtctttgtcatataggttttgcagtagctgcaagaaggctggaacttggaactggtttatacttgtatgtccgtccagccataaacctcttatggaaacttaatgttatttctagtttaatttgttagcttcaatgctgttcatgtgtctggctgttaaaagtgtttgtgcttgtttgtgtatgtgatgttgtacctgttatctggtgtctgaatcaagtgtttcttgagtgaa

SEQ ID NO: 877 - DNA, 256 bp, Setaria italica
gcccatttatttgttatagaactgtggaaggagatgtctactttttgggtccagttctaactagtcaatacttctggaactcatcaatgttagttttgatactgggtgtactggttattttctgtgctatgttgaaagagtttggccatgataacgggaggtttgcctgcatcaagtgcaacattgcaatgcattcatgtgcatcatatacccttccggtaaacttgatatacgtattcattcaccctgtcatgca

SEQ ID NO: 878 - DNA, 271 bp, Setaria italica
gtttctgagtgaaatttgacgtccaagaggttgccggcttgtcagtccgttgcctcgaagcaatacagaaagggcagaggcagagtataagtggacagaaatacagtagccgtgtacctaggtcgtgataatgaattaagcatcaacacattatattctgtggtgtttcatgccgtttggagtggattgttcgtgtatttggtgtactgtttagttcgcggtttattggttccggctgatgcctatgtggctatgcgagcctaagataata

SEQ ID NO: 879 - DNA, 164 bp, Setaria italica
gtcgctgtgtccattgcgtctaaaaccagtgccgtagacagtattgaagtttgttatggaatatatgtttatgcagtactctgtcgtactgttatgcaaattttgtgtctgaagtgaacaagagtggttttgtgatgcactaatgtttttcaccttgcacttga

SEQ ID NO: 880 - DNA, 237 bp, Setaria italica
atgatgccggagaagccaaatttttgtaacagtgtttagggggcttatgaatgactcttgggggccggcggtgacggagactaatcttcttcctctgaatgggtgtatcgctgctcttttagctgctgagtgtagaactctggttttttttttttaaacttccttgtgatttttcttgttattatagcggattcgcatcggaatttatgtgaagaaaagaagatgcttcgggattta

SEQ ID NO: 881 - DNA, 280 bp, Setaria italica; identical to SEQ ID NO: 268

SEQ ID NO: 882 - DNA, 146 bp, Setaria italica
agatgtcctggatctctatttcatttctttgaagcaggatgttttggttggggtctcaactagtttgctccctctgtacttcaaaaccatagttttgatgccaaagttgttgcttaggtgttcggtacctggaaattggcagtgaa

SEQ ID NO: 883 - DNA, 472 bp, Setaria italica
tagcctggtaaaccttgatggatggttcggcatgtttttcctgtgctgctcgaagccgtgcgcttgctcctccatggattccctgactccgagcttcatgtagtaggctggtagtggtcggattattagccccattgctttagttggcactgggtccatttggactgatgctattgaagtcgtctttcttgttttgctgttgcaatttgttgctattgtgttctgttccgcgttctttctttcaatcgttcaatgctctcgttttgctttggcaaacacgtctggtcgtcctgatcacgtgatttcgtcaccaaagccagccgttttgttctctatcgaccaagcttagagatgcccttttcccaggcaaatcattcgaatggtgttagtaaacccttaattgtttagcgtaacactgagcaaccattccagtcaaaaacattgtaactgtaacttgatcttgctgctaaat

SEQ ID NO: 884 - DNA, 443 bp, Setaria italica
tcttcggagcgggcatgttgttcgagcccattgttttagatgctcaatgctgtcgaagctgtgccgtgccattattgtagcttatttcctctcccctcactcctttttccttgtattagtaggctggtagtggtcgaattagttccccattgctttgtgttgccgctagttggcactaggtccgtgtggactggtattgttccctgttgcggtcttagcacgtcaagaccgcgatgggatcagattcactcgtgtgctcgactgggtcagagaagaattgggagaaacgaaaagggaaggaagaacagcgaagaacgaggaacagaaaaagagggaacagacagcatagccgtgattgatcttcgtttattccttgtctgtgtaatgcttacacctttatacgcgtttttacaacagcctttgggtccctacccttaacttaa

SEQ ID NO: 885 - DNA, 433 bp, Setaria italica
cccttagatgtcctgtgctgtcaaagttgtgcgctgcgccattattgtagctgctatcgtctaccccgctcgcttcttttcctatagtaggctggtagaggtcgaattagttctcattgctttgcattgccgctagttggcactaggcccatgtggactggtattgttctcctggatttgacaagcatgtgtgtggtcggtctagcgttttattgagcaatatcagtccacatgggcctagtgccaactagcggcaatgcaaagcaatgagaactaattcgacctctaccagcctactataggaaaagaagcgagcggggtagacgatagcagctacaataatggcgcagcgcacaactttgacagcacaggacatctaagggttactgtccctcgccagcatcgcctttcggggcttctttgccctcctcag

SEQ ID NO: 886 - DNA, 259 bp, Setaria italica
ttcttcggcaattctttgggcccaagaaatgcaagctgagaggagccattatcgccagcctccttccccatttctttctctttttgttactgtttcttcattagcgtggacaaagtttccggccagtctatctgcgatcgttttcttctattcatcaagactgtaatatctattgctacctatgcttctcacttgtgattttggacacatatgttcggtttattcaattttaatgagatgcctgatgaggctactagca

SEQ ID NO: 887 - DNA, 270 bp, Setaria italica
cttccctaaagaaggccggcttttgaagagggaacagttgtatctgaaaattgaaatcgaaaaagacgtgtatcgcgacgaaagattggtaccgagacattcgccctagcttgagctggcttttgctgtagtaaactcaagtgcagtgattgctgggtgtggcatcgtatctggatcattatctgtggttacatttgggaccctgtattttctatggttttatgccctctgcttagtatcaataaattggtttggaatggttgaatttaa

SEQ ID NO: 888 - DNA, 396 bp, Setaria italica; identical to SEQ ID NO: 269

SEQ ID NO: 889 - DNA, 465 bp, Setaria italica
aggagctgatcaaccccgaagtgacagtgacaatgaccgagaacactcctgatgatcctcgccagaggaagccagacatcacaaaggccaaggaagttcttggatgggagcccaaggtcgtcctgcgcgatggcttggtgttcatggaggacgacttccgggagcgccttgccgtgcccaagaaggcataaacccaccctgcttttgggggaaggatatccacgggaggagcatactcatagttgggttcgtcattattcgtggccaccatttcattacggaatttgagttccaataaaccgaatacaccctttgtcgttcaccttgaaagattgtatcattagaattcccatacagggccggccgttttgcgtctctctgcttccgcagatcttgtggtacttgtgtttgtagcctatgcactccctgaatcgattatagcaatgttgccattttgagctttta

SEQ ID NO: 890 - DNA, 290 bp, Setaria italica
gctcaagggctcacttcgtcttcattctctgtatccgttccgttccgttccttgattctgtttcatgtaaggtactatgtttgagactgccagcctttgagcaggcagtgttgttggatttattattttgtggctcgctacaatgcatgcattgctgcagctcctttccatgccaagtttgttgctagtggtgaaaacaacaaaaagaggttggaagttatcagagtacctaggatcatttattttggctgtatgcgagacacattattggtttttctttgtacatccat

SEQ ID NO: 891 - DNA, 246 bp, Setaria italica
gtttctcaactgcatcatcactgtcatctagtctcacgttatgtctggttcatttatttagagatgtgctgcagaacagcatactatgtctattttcttcagaccatgattcttctctgggataggccccctgtatgctgtggcttcatgtgcgagcgtgttgtgttgtatcacctggtttgttgtaaaacttgcttggcttggcttggttggagctgtaagctgatagttctataaattgcttgg

SEQ ID NO: 892 - DNA, 264 bp, Setaria italica
agacggatttacgtgccctagaaactagtcgctagtgtttgctgctgtctaatgacactatgcaatgtgatctggaccctggtttctttggtgcgacgctgtagccgtgctatgattattgtcgggaaaatctgtgggctccccatatgagatgttgccgggcaaggcctcgggtgcgtcccacttgttggtgggggtcactggagccaggtttggttgggttgggaagcccttttaaaactgttggtgttactttgtatttta

SEQ ID NO: 893 - DNA, 262 bp, Setaria italica
gtcttgccgtgatccttgtgaagttgataaaaaaatactaggacgtcgaactgggcttgtcttaaacttagatatgtacccatcagttttgtgcctgtcaatgagaatgtcgaagtatctggtccaatctagtgtttcctttaatagaacatgtggaggaatgccttttgggattatgcagtcgcagcttgtgttatggttcttttgccacccctttgtctcttattagctgctctgcagtcttgatatcattggctattgg

SEQ ID NO: 894 - DNA, 431 bp, Setaria italica
  misc_feature (1)..(431): n=a, c, g or t.
  misc_feature (300)..(300): r= g or a.
  unsure (1)..(431): unsure at all n locations
tagccatcgatccaagtgactgccatctctatctcttaaccctttgggtagtcgtgatgcttgtacaaggaccattttcgttgtgtcctttatcatcgggtctgcttacctttccttttgttatattgctatattgttatccccatgtattgctttactttcctcctggaaccctgttagtgtgtgggggagaataacctaagcctgccttttaactagtacaaggattgtcaactcttatgtactatgattgaatggttatgcatgttccatatatatccagcaaatcctaatgatngrcttaggttgtggatttttagctgtgtgattacaatcatcaccctttttgatcttggatgagatggatcacagctggagccaacattattgtaataatgggtacgaaatgggcgatgaaattggagttcaaa

SEQ ID NO: 895 - DNA, 390 bp, Setaria italica
aggtgcattgccactgttggttatttatctggtcgtctatttgggaggtggtgtgttgttgatgatataggcgtgtttggttatgagtaacatgcttctggactgccgttttgtcttgcggtttatgcggagtgatttggatgtacctttactatctgtaatgttcttttgaacaagtagctttgctacgtcttgatcgcgatcatttacgtcagatgataagtgagcttacatcagatgataagtgggctgttcggaagtttgtgtagtcattttcccagtgtcgccgattcgcagctggtgagttgtgacgcagagttccggggctcggtgctacgagtgcagcgtctaaacaacagatattcttactttctgcttttcaagttttaa

SEQ ID NO: 896 - DNA, 441 bp, Setaria italica
accgcgccgccaaataaaaagcttaaatactgagactcttcagctcctgcatgggcaaccatgaagtgtctgttcgtttttttttttgcttcgtgtcaccttgattttgtttttttttccttgcttgcttctgctgtatccatggcatgcatgcggatctctccccccaaccggagagttatctacataggactagctactatacaactatcgatcgttgggtgaggaacatgtgaatgctagctccggctatgatatgtaatatggatactagagcataccctgccaatccgccgacaatactagatcatggttaattactggtgtttttgtctaatttttgtgtatctttgctcaaacttacgcttctacgtaaatcaaatgtcatgtatcagatcagttgaggaaataaaggcttacaatacctgtcctttttaatta

SEQ ID NO: 897 - DNA, 388 bp, Setaria italica
accggcggcgccaaataagcttatcgcgcggaccgctcgctcgtgagcgaccgtggatgaagtgtctactcggttttggcaacttaattatttgacgctctgtttaaagtcgcctgcttgttaattccctttcttttcgtgtttccgtcctgtgtgtatgtacgaatgtacatgtatcaacgtaggctgaggagcatgcatatgtgaatgctagcgccggctaaacttatacgcatacacatcgtaatatattgtatacgcaattcctccactgcctcatctgtttcttgacgtataattatatatctatgtactatcggcttgtttggttggatgtaattggtgggtgggaaaaaagaagttttaagaattagacgaagtaatttaa

SEQ ID NO: 898 - DNA, 247 bp, Setaria italica
gaagtgagttagtttgtatcttgatgaatgaaagcagtgttttagtatgattgattgcccttgtccttgtggttattttagcactttctgttcatccttggttgatttatctgtaaaatagaaccggaattgggttcctttgtcatatacagtacggttatgaaaacaggaagaattaaccagtgtcactgtgaatagtgatctggataagttcattttgttgagtgaatgacccagagagaaggaa

SEQ ID NO: 899 - DNA, 231 bp, Setaria italica
tcgtcactcgtcacttagccttattccgggtcctggaaatgcgttggttttgatgacttgtctatgggtgtatctactctactatagctcgcggttttttgtgcatgcatatatacatatcctgtaacaatgtggagccaatcgggcactgtatgaagtatgtagtttgttttgaggtattgattgaattattcgattcaatgggtacttggatgcctaagaaaaaaaaaa

SEQ ID NO: 900 - DNA, 157 bp, Setaria italica
tcctaagcagatgccacccgtgcaaaatagaaattttgatggttaggccgtacgctgtctttcatttgctcttgtttggaattggtggaagcttttgaactgtaatttggtgcaaaacgctacgaaaaaaataagatgagttgcttagaacttaaaa

SEQ ID NO: 901 - DNA, 373 bp, Setaria italica
ttttatattttgcttactactagtaaccttgaaggaaaacaaaaacaagagaactgcagaacgagggctgcactgcactcctgcgctcaccttctatcatcatataatatgatcatcttccggtgcagtgttacagctgctgttagtggagggcctttgcttgttctgatgacgcagcccatagctgctcgatcggttttccagtaatttcagtactattctaatgctctgtttttcctttcctttccttttcttttcttttcttttctcttcttttgttgccccttctgccttcctctcttctatgctgtaaatgggaggatggtactgctgaggattaaaaaaagatttctgaagaaaatatcatgctgct

SEQ ID NO: 902 - DNA, 201 bp, Setaria italica
gcgcgatgctacggtaaccaggccatgttgaagtgatgttgctagggatgtgatgaggaagtactatttttttttctgtttgttttctctttgatgagctaatttttgagttcgtaatattaatctgtagcatttttctacggaaaaaaaaatctcgagagtggatcattggaataaaaataaattgcatttcagtggtta

SEQ ID NO: 903 - DNA, 308 bp, Setaria italica
gtccctctccttcctgttcgtccagccttgcgaccttgctttttgttggtttcgttacatgccctcactgttgttaatgttaaactcacatggtacatggccttgtagatctgttcagtctgttctcggatatggttttgtgcattaaaatgatcatatgatcgatcttcgtgaggcgaaaaaaatcagactgcctacttaatggctagcaaaatttcattatgatttgagtcagttttcattacaaatgcaaggaagccacgtaatgagctataaatgtgccaaataaaaattgaatgttttcttta

SEQ ID NO: 904 - DNA, 218 bp, Setaria italica
gccatcgagcgtgtttggccgtggtttacttactcaggtatttgagttccgtagttgtagggagacgaggaacaagtcagatgcaatttggtttttaccataagtgtgctaggaggaatcagccatgatagcttgcaatgcaaagatatcgaatgtaattaggacggcaagcgcggttcatagagtcagcacagggaagcagagtaaaagtcaatttg

SEQ ID NO: 905 - DNA, 144 bp, Setaria italica
aggtggccgcgtttgccttcttctgatgcttggatcgaatccagtgttcaaagtggtgcccaggcaattcatgtatcaatagcaatttgaattttgtagtaggacggaacctttttgtgagtaccataattcgaccgagattag

SEQ ID NO: 906 - DNA, 271 bp, Setaria italica
taaagcatcttgttttcctcaagaaatacattgacagatttttttcgtgcatgataaactttgtggtcattccctggtggaacagcagggtgaatccaagatgacattgttgttggatgtaggaacacttgattaatcagatatgtcatgtgatactgcaaaccttgcccacgttgttggttgctgtgcataggatgattaatgcaaccagaattttttaccatccttacgaacggtcaatattcaaatgccaattttagaaatgctacct

SEQ ID NO: 907 - DNA, 270 bp, Setaria italica
gtttctcaactgcatcatcactgtcatctagtctcacgttatgtctggttcatttatttagagatgtgctgcagaacagcatactatgtctattttcttcagaccatgattcttctctgggataggccccctgtatgctgtggcttcatgtgcgagcgtgttgtgttgtatcacctggtttgttgtaaaacttgcttggcttggcttggttggagctgtaagctgatagtcccaagcaatttatagaactatcagcttacagctccaacc

SEQ ID NO: 908 - DNA, 327 bp, Setaria italica
gctcaagggctcacttcgtcttcattctctgtatccgttccgttccgttccttgattctgtttcatgtaaggtactatgtttgagactgccagcctttgagcaggcagtgttgttggatttattattttgtggctcgctacaatgcatgcattgctgcagctcctttccatgccaagtttgttgctagtggtgaaaacaacaaaaagaggttggaagttatcagagtacctaggatcatttattttggctgtatgcgagacacattattggtttttctttgtacatccatctctgagatatgcaattcctttgatcgattgctattc

SEQ ID NO: 909 - DNA, 346 bp, Setaria italica
gtttctgagtgaaatttgacgtccaagaggttgccggcttgtcagtccgttgcctcgaagcaatacagaaagggcagaggcagagtataagtggacagaaatacagtagccgtgtacctaggtcgtgataatgaattaagcatcaacacattatattctgtggtgtttcatgccgtttggagtggattgttcgtgtatttggtgtactgtttagttcgcggtttattggttccggctgatgcctatgtggctatgcgagcctaagataataatacaggatgaagcaaacctgtgccttttctctcgttccttttcccggaagaccctcgttgtgcccaaaaaaaaa

SEQ ID NO: 910 - DNA, 348 bp, Setaria italica
ttcttcggcaattctttgggcccaagaaatgcaagctgagaggagccattatcgccagcctccttccccatttctttctctttttgttactgtttcttcattagcgtggacaaagtttccggccagtctatctgcgatcgttttcttctattcatcaagactgtaatatctattgctacctatgcttctcacttgtgattttggacacatatgttcggtttattcaattttaatgagatgcctgatgaggctactagcaaatacatatggtgttctgattgtcattggttattgatgtcttatgaaatgaatgaataatatcaaaatttgagctctagtaaaaaaaaa

SEQ ID NO: 911 - DNA, 389 bp, Setaria italica
gccctggattcaccgtctttctgctttattggggctgttcttttgttcgagtccttgccatgtaagctactgtgtttgagatttctggggttccattgagctatattgccggatttgttggttgggtcaaaaccatgtaccttttagactctgttcagtggctgctatattcaaccagtgctgaatcatacattgtgtgttcaagtatcgctttgatggcaaatttggtgccaatgttaaagagtattgaactatctactagcatgttctgtaatagtttttgaatgactcattatcatttctcttgtacattcattctggttatgacctagcggtggtgtcgcccagttagtgttgcccagttaattcatgatttctgatgtaggtaa

SEQ ID NO: 912 - DNA, 471 bp, Setaria italica
gttcagctgccgttttcgtgtagtctcctatgtgtgggttttttcatggggggagagaagattgcaggttatgtttgtgttctgcagacggtccttatttcggccacttgtatctgtggttgccccagttacctttgtactcctactatttcgtcgccctgtgacagtgaggtcacctcgtggaacttatggttggcttgatcggttgaaactgttatagctgatagttctataagtttttttgtgggtagaggattatgtggatttttaaaatttattatttttgtgtgccagtgcctacgatgccttgggtggttgttggctcagttcaaatctatggtgctaaagtagcagctctgttgttctccgagaatcatttggaagtgcaactgtggtgatgatcatcaattcgtggtgacattatatgctgcaactgcaagtatcattcgtggtggttgccgagttgaaacc

SEQ ID NO: 913 - DNA, 178 bp, Setaria italica
gctggtactgcggtagtgtaaatgcaagtcctcgtctgccatccaggacttcataggcttctctcttgagtttttgctatagatgagcggtgaataaatttgccttgcgtggacaagagagttatgcagggaacaaacgtaaatgctatggatgtgctctattttgccgtatgctaaa

SEQ ID NO: 914 - DNA, 334 bp, Setaria italica
agcgggtgaaatgaaaatccacaagaagagaataaatgaacaatgatctagaatccacaatggcttttagttttacagcctagaattttttgtgtcgacagtaggaagatgctccagacgagctgcaattgtggctgttgttagcttctaatggatacgtacgtgggtgctggatgccccccaagttatctttttctgaaccaggccctgcttaacacaacacataaattttgctccttttccattgtggttgtgtctgtactctgtaggttgttggagtttacaaactaccagagagctaataaagcatttttacgaaagaaatgtgtaacca

SEQ ID NO: 915 - DNA, 540 bp, Setaria italica
gatacagatcaccctggttatcaggtatcctgtgagctagacgtcgggtcaaatcctgctggaagaagcagagagttgcaaaagactgcataagagatgcttatctctctattgccatctacatggtgaacttaaagataagctgctgagtttgcaccatttccattggctattgctacaagttagcatctagtttcaagatatgcaacaaagcagctttagacacctgggagcacgtagattatgatgtccaacttgggctttgaagccatggcactttctctaggcagccatgcttcattacgagcgcccatagtgttgttagaatagattaagatctcaagttttcatgacttaatcatgccagcgtcttgttgtagtggaatggaaccgtattcttgttttactggttgaggaatcctaataattttggattgtagattgtagggaaatcatgtgcgtgtcaaacactgcaagtgtgagttttagccagaaagaaattagagtttgcggattggaatgcaatgctctagcaatacc

SEQ ID NO: 916 - DNA, 265 bp, Setaria italica
tgagttatctcttgggcatcctttgttcaagctagatatttagttctgacagggggtgaaatcaatattatgggctagggcattatttggttacaaatccttttatacgggttacttccatggcaatttttgtaggtgtagacttgcccgccacttccattttaatgttggatggggtagtggccttatcaataaagcatgaagatcgaatgcatcaaaaaagttatgatatccctctataagaaaaagctactgcgccacccac

SEQ ID NO: 917 - DNA, 384 bp, Setaria italica
tgcaccacatcacatgatgaatggatggctattttcctttgcccccataaattggtgagactttgcaaggaaggttcgactccaaggtagaaggcacaccttgctgcttctgttggagtaaagccatcgccatacctatttatgtagtgctggtttggcttttgttaacttgttagattgtgtagtgcatctgttgttgtgtgtctgtattgtggtttatggtatcaacttactggtgcaagtcacctagtatttctcaaataatgataataaatatgtaacccgaatatctgataataattatgtaattgagatccgggctgcattgtttcaaaaaaaaaagtaaaaaaaaaaaaaaaaacttaaaagaagaactagccaagg

SEQ ID NO: 918 - DNA, 275 bp, Setaria italica
gtatcacaagagcgccggccgtggacaaacataataaatcagccatcatctgttgttttacttcaagaagaaatagtgacgtttaattcaacagacatgtacttagacatacaatgtacagtcctttgactcaagtttaagagattcaagagccaagctcgacaaagagcacagctttacaattgaacctggaatggaatgcatccattcctttggctttaggacgattacatgtatcagaaatagagatcttgaaggagtgacatctttcgcgt

SEQ ID NO: 919 - DNA, 273 bp, Setaria italica
agctctgcaccggatgcccttttgttgtgattccagatttccagtatagtagagagtagaggtctaattttttattctttcaagcgtcgagattaataattctttcatacgtagacagagtattccattatgtacatatcaacaagataggggaatttgggcagctactaatgttgttccgagattttatccaactgtatattgccgaatgggtcccgttcaattgatcaaatatatatcattctgttatattctatttcttgtaaaaaaaaa

SEQ ID NO: 920 - DNA, 185 bp, Setaria italica
taggcaaaactaactgtttgcctgattttacagacaactttgattttgtagtgcagcattcatcagcacttaaacatttttgaaaactagaataattatggagctagtacacgagatagctgacctctttgtaaacattctttatatatcaatgaaaaatggggttaaggttttctgtcttgtaa

SEQ ID NO: 921 - DNA, 374 bp, Setaria italica
atacgacatgtagctggctgatcgatcgaccgtctataagtgtatctatagaactcagaagaataagtggtgaacgacccacgacagaaagtgatagaagcagcatcacttgcatggccaggttattgaaactgttcacctggtcattttggttggattgtccaagttggttgtgtgtgccaaagggcggcacaccaaaaaaaattcccctcatattagtactagactttcttttctccactagccttgcctgcatatttgtcttgtttcccccagtagtgaacaaaatatcatatctttgtacaacacttttttagggctttttcttttcaaggggaacggtgccctttatctcaggcgatggttacatgttg

SEQ ID NO: 922 - DNA, 177 bp, Setaria italica
aggcggccaagatgatccagtgaacacctacatagtatatagttgcttgtggtagtgtattgtagtggccagcggcatatatgacctaataagtatgaactatatatatacactatatattgcgagtaaataaaaggatatattagtataatctctgctgctgttctgtgtagacaa

SEQ ID NO: 923 - DNA, 908 bp, Setaria italica
cattaccgtatcgatacattctgaaggcatcagtttcaggtagaagctggcttttccactgccagggctgatacgacggctacatggtgccccacacaaatctgtaactaggcaattttggtggtctacagactaaaggcttaaaggttgccggattcagatatagggttatatgcaacttggtgatgattaaagcagctgattagtctctttattcatcaatagagaggctggagtagtattttgggctgcagataagctgtacatgctttctgcagcaatctcagcgggtacatgtatgtctgtatgtaggagatataggtgtactgtacatgattctttcagtcctagcaaggactggagcaaagattttgcaatgcaagacgtttattgtaagttacaagaaacagatgaaacacatgcgaactggagattccagcataaaagaattgaacactttgatagattcatagatagggctacaagatgagtgctacgctgcatcagtggattacggttgcttcagagaaaaccatgtggaacatagactgctacagctgctgacaaagagatcccaaggaaccaactccgatgtacgcggcgcatggtcgtaatggaagctggccacctgcgctcgggagcacgaagtccacccgccggtggtggcggtggcagcggctgcgatcccgtcagtgcgggcttctggtttgacacctgcgctggttcatccgcgcgagtcatggtatgccgaaatggcacagaggcttcatcagcttgtaccgcgacgtgtcggcaagttcacaagcggggtgcacgcccgcttcaccctgcgaggcccgacaggcatgctcatcctttcgccactctctgacgaagcgaggaggacaaattatacggttctactcacg

SEQ ID NO: 924 - DNA, 604 bp, Setaria italica
gaagctttaggtaccagtaccccaatttcccattttcgttgatgcatagagctccccttttccccgtcaaacttgcacaacattaccagcctccagagcattttcaccacctgcataactattccccattgagcctgagcacaatgagctaagactgtcagtgaaagagccccacattccccatcttctgccgccttttttttttaccattcacccgttcatatgccgatcccattcaattcaatactttttttttcatattttgggctcctttcacctcatatgtattttgatactccattttgatttacctctatcatagtccataggccagcaccctgcttctcaagaatggaaaatgtctgtaatgttgtctagatttagcatacatcttttagggaggggggctgggggttgcgattttcgttacatgtaaataccttataggaaaaacatgagagaaatccattggaagattggtttccctggagagacaaagagaaatggtggcatcatattgagatgagattttggtggttggggtcaggtacagggctagtagctattttgagtttccattagagtctttgtctatctatctatg

SEQ ID NO: 925 - DNA, 263 bp, Setaria italica
gtggccagatcaccctgttccggtcggccctgtacatcgtcgcccagatgtggaagcccgccgtcgcgggcttccacaccgccagcgcctgccccagcgccaccgccgttaggttgcctccggcgttggtctttccgtcgattgtcatggcggccccgacttggatgaagacgaagaggaaggcgaggcgtcggagccggacttcttccgcggcgtcctcggcgagctcgtcctcaccttcctcttcgtcttcatccaagtcc

SEQ ID NO: 926 - DNA, 383 bp, Setaria italica
ggaagtttcataaagactggactaaggtgatcgtgtgaccaacggtacggaggtaacggtaaaagcagctctacttagaacagtcttattggaagtttcataaagagtttcacgggcattaaattctataccacatcaagcaattttgctgacgtggtaagatcattgggatgagagaggagggagagttttcatcagatgcgagaggagtttcatccccatgacactcagttggctcggttacctagtttgcagtcttggtaactgtgcatgaaactatgcactgagactggccttattatttatggttgacatagtaataaattacttagactagtaacaaacaacaattagaataaatttaatttactaacttaggacga

SEQ ID NO: 927 - DNA, 407 bp, Setaria italica
aaccaaagaaggtaatagacctaccaacctacaagaaactaataaacccaccctaacggtggttacccaccgcagggaccccaagaggcggcatgggctgggaccaaaggcagggccctccaccccatccttcatatcagggtggtggttctgactactacaagcagggatctcaaccatacgatagccagccaccaagctaccctcctggaccagggaactttaacagttatgggcaatctcaggctcctggctatggacaacctccgtatccgcaacatgcacctcaacagaactatggccatgggtatggtgatcctagatacaatgctccaccgccgaaccagtattatgggcagccaccaatgggtcctcagcaaggctatcctcagcagccagatccttat

SEQ ID NO: 928 - DNA, 975 bp, Setaria italica
ggggtagaggagcacgaactcgccggcggccagcagctcgtagatggacttgtacatcatgggcacgccgccccacagggttgaggaagtcgaagaagtcatggccctccgaccacgccctcttcttatctgggaacagctgcggtgcgcgatgccgcgcacgaccaccccttgaggcgcaggaactccgccgcaagcgagatcagctcgatccccagaagcatgtggttgccgacgagcagcaccgggccgtcctggggtactccggcaagacccctcaccactgtgccgtcttgcaaagtggagtacatggccgggcaggtcctgaatctgagatcacgggtagctttgtctacttccttcagctctgttgcagatggagggatgtagtcgaaaacccggtggtaccgcctcgaatggcggtagagatcggtgcacttgatgatggacgcgacatggacaccgtactccaacagtaagctgtgcccatgcttgtcaaaaaaatagattgtgcattttggtaacaacttctgtagcctgtcagcttcagctttgcttggaagtaacttgtcagcacagctggcaagaagtagaacttcagcttgaactgattgtagacgataattagcataagaggcagcccgtttgatcagcttcattttccatttcatcgtatcctttggtattttgtcaagtatgttcgaatgcttcaggaaagatgacatgttacttgtcaatctgttcagttcttctaagggatgcttcccatttatcatgctacttactgccatgtgcgcttcattgtcaatgttgtagttcaatagagctgtaattgccatacaggcttgatcggagaataggctgaaaaacgatagaagctgctgtatgcttgacttctcatatgatgtcgctggatttactagcaccagtatcaaatcaatatgtggttacgagtcagctactgcaaggcgaggc

SEQ ID NO: 929 - DNA, 288 bp, Setaria italica
ttaggttacggttacgggttacgttaccttaatttgtcgtagtctacggtcctacgtttcccgtcttggtaggttggtcgtcgcaagcagatgcaggtgggcgccgtcggcgggaggcaggtctaccggaacgtcctgcacgccatgtactgcatcctcaagaaggagggtgccgctggcctgtaccgcggcctgggtccgagctgcatcaagctcatgccggctgcaggaatctccttcatgtgctatgaggcctgcaagaagatcctcgtcgacaaggaggacgaa

SEQ ID NO: 930 - DNA, 140 bp, Setaria italica
ctggtgtggcagccggtagcagcaccagggttgaagttcatctgaggcaggttctgaagtccttcccacattgcaggtatctggttcattgtgggaaggacttcagaacctgcctcagatgaacttcattcggcaagcga

SEQ ID NO: 931 - DNA, 212 bp, Setaria italica
ggagaaatcctggccgtccaaaaacagagcaggcaatttgttttcttttcaggtgtatagtacaaaatattcgcacacaaaatagttgccgacgagacaataggcaaggagagaagaaaagaaacggaacagagaggcttggctgcttcacctggtcgtcggcgtccaggggatcgaagagcccggcgtcgtacatggccttcttccccttg

SEQ ID NO: 932 - DNA, 143 bp, Setaria italica
aggatgttaaagttaacattcctgcctgatgccatcttcctagattgaatctgtcatttttgcgctcgctgaccgtttagactgttctcaaaatggttcatgtaatgtttgacctgtgcagaacatttcgctgatgtatatag

SEQ ID NO: 933 - DNA, 164 bp, Setaria italica
tgctgactacaacatggatggggaagccctggggatagcaaatatgactgaactacgctccctgcagatctttggctgtagcttcaccaaatttggggaagccctggggatagcaaatatgactgaactacgctccctgctagatctttggctgtagcttcacc

SEQ ID NO: 934 - DNA, 106 bp, Setaria italica
aggagcaaagttggcttcttcaggtgccatgtcagtcacgacttgtcaacagtacaactactacgcttcagagcaaggctatatttacaaggaagaaagagaggaa

SEQ ID NO: 935 - DNA, 213 bp, Setaria italica
actcttcagtcgttttgggagcagaagccctcccagatggtctagtgcaagcatcttgaactctttgggtattacttctccaaacacatgagatgtagaatgttcagtatgtaaattatttactatattattattaggctgaatatgtaacgtaaattattatttgctactccatctatcccaaaatataaggattttgaagtttaaaaaaaa

SEQ ID NO: 936 - DNA, 222 bp, Setaria italica
acccatagccatactgcaagttcgatttcatattttcgtgcaccaaactccaaatcataaatatctgtcttttcctagagaaacaacagagaactgtattttttatctgtcttatatttcgtaacttgcttacttgcataaccatgtcctgcatacaacatagacatgatcgttgacaatacgttagaattgaattagtttaggaattagaaatacaaggta

SEQ ID NO: 937 - DNA, 113 bp, Setaria italica
ctgcaggtgtccgtcccggtcagcgggatccgatagtcaaactgcatgcacgggaaatgatgaacaatggttctagtttctacttgtcttgtattttgaatgacacgaattcg

SEQ ID NO: 938 - DNA, 250 bp, Setaria italica
ttttagttttaatttttagttttacttttaacttttaaagttttaattttagtttaacttttctttatttgttcttacttatttccttttgttaggttctttcttattctagggcggtgttgaaggtgggacacctactgatattgctgaagaccaccactacaggagtggttttgatggtgttgcagaacatggggttctttgggtgaccattgcgacacaaaaggttgggagtttgggtttcactacc

SEQ ID NO: 939 - DNA, 261 bp, Setaria italica
aaccgaacaaacgaacaaaaacaaacaaagaagaacccctaaccgaaaataaccgaaaagaaataactaagggaaccggaaccaagaccaataggacgaattaagggtttggctccccgccctcctcctcgccttcctcctcgccgcctcccccttcacccaagttgctagagctcagtcggaggaagatgctgctacagctgaggttgttgaaggggctgatttaggaattgtgggtgatgatactcaggtttccagtga

SEQ ID NO: 940 - DNA, 117 bp, Setaria italica
tccgttagtttgtagttctaaatttaagtccgtctaggtcttcctacgtccttggttggttgtccctttccgttctaatttccttttaagttttctagtcctttgtcgtacctatta

SEQ ID NO: 941 - DNA, 203 bp, Setaria italica
ccgcaaacatcttatcatcaccggcactcttcctacaacaaccttgggccctatcgcagcagcaatggcagcaaagatatttgctctttttacgctccttgccctttcggtgagcgctgccactgcagtctttcttccgcagggatccctagctgctactgccgctattccacaatacctcccaaggctgtcacatgtgggag

SEQ ID NO: 942 - DNA, 309 bp, Setaria italica
ttactaataattattactttacttagggtactaacttgggtaagtaagtaagtttcgtagtcgtctattgtcttgtattgtagcgcggaggagaagtaccccgacaaggtgcgcgccgtggtgaagttcaacgcggcgctggcgcaccacatcatggccggcgccgacctgctcgccgtcaccagccgcttcgagccctgcggcctcatccagctgcaggggatgcgatacggcacgccctgcgtgtgcgcgtccaccggcgggctcgtcgacaccgtcatcgaaggcaagaccggattccacatgggg

SEQ ID NO: 943 - DNA, 165 bp, Setaria italica
tagttgttaccttagcccaaaaggtgaaccacttcaaaacgacagtaatactctacatcatgtacatgctgttgggtcatttgatggccgcatgggtcagcactcagcagtcagcacatgatgtagagtattactgtcgctcaaaaggtgaaccacttcaaaacg

SEQ ID NO: 944 - DNA, 193 bp, Setaria italica
ttacatgcgccttgtttatgaacttggacatgtttgtctcacaatgttagatcacttttgtgttctgttgatgaacttggacatgtttgtctcacaatgttagatcacttttgtgttctgttgatgtttgagctgactttgcgcaactattaaattcttgacctgatatagatgttttttttaaacctcaaag

SEQ ID NO: 945 - DNA, 148 bp, Setaria italica
agaccggtcaagatatgatctaccactggaaaaaaaacaatgtcacgctttaaacaatatattagataacaacttacgactgatgatctgatagcagtatagatggggatcagatcatcagtcgtaagttgtatcagattcacaacaa

SEQ ID NO: 946 - DNA, 150 bp, Setaria italica
cctgaagtatggaacctgtggaaaaagcagaccagtacttaagtagtcttcgagagtttctaattgacagaggaaattttgtgttgtgctttggctgtgaatcccttgatgtgttaattaattaaatgtactatgggatgaaaaaaaaaa

SEQ ID NO: 947 - DNA, 162 bp, Setaria italica
ttcattacattctgagactgcatcaacgttctcatcagatcctgaatcttttgctcataggagccagcttggtgcctatctctccactggccaaaggaatttctgcattttggaggtcgagcttggtctgactgtcttgaaatggcgcacatacgtcactga

SEQ ID NO: 948 - DNA, 164 bp, Setaria italica
cagagagtaagtttcctggtgtggtacttttacaaggaaacttactctctgtgttgactagtttgcaacatttggtagcgcaagcagtgcaacacagagagtaagtttcctggtgtggtacttttacaaggaaaagatctcaaactcttccgggcttatttctg

SEQ ID NO: 949 - DNA, 178 bp, Setaria italica
tttggctgggataagaagccaagagtaacatgctgtcttgcatgcttgtcagaactgcttatgtctgtatctgtaatttactaaatactaaagcatctagatgtaccaaaccataagttaccactcaatatacatgttcaggtcaaatcatacaccatgattaatttctatgctatgg

SEQ ID NO: 950 - DNA, 1570 bp, Setaria italica
gccgccgtggcgaccggcgcggcgaggggtccggcgacgagcgcgagcgggagcaggagcaggagcaggagcagagccggcggccgtacgtgttcgaccggcgcagcttccgccgcgtggtccggagcgagcagggatccgtgagggcgctccggccgttccacgaggcgtccaagctcctccgcggcatccgcaactaccgcgtcgcgatcctggaggccaacccgcgctccttcatcgtgcccagccacaccgacgcgcacagcatcggctacgtggcgcaaggcgagggagtggtgacgacgatcgagaacggcgagaggcgctcgtacaccgtcaaggaaggcgacgtcttcgtggcgccggccggggcggtcacctacctcgccaaccccgacggccggaggaagctcgtcatcgtcaagatcctccacaccatctccgtgcctggcaagttccagttcttcttcggccccggcgggaggaacccggaatccatcctgtcgagcttcagcaagagcgtccagagagctgcttacaagacctcgagcgaccggctggagaggctgttcggcaagcaggataagggcatcatcgtgcgcgcgtcggaggagcaggtccgcgagctgcggcgccatgcctctgagggcggccacggcccgcactggcccctgccgccgttcggcgagtcgcacggaccctacagcctcctggaccagcggcccacgatcgccaaccgccacggccagctctaccaggccgacgcccgcagctaccgcgacctcgccgagcacgacgtccgcgtctcgttcgtcaacatctctgcaggctccatgagcgcgccgttctacgacagccgctcgatcaagctcgcctgcgtgctggacggcgagggctacatcgagatcatatgcccgcacctggcgcaacgtcatgagggccggagcgagcgcggcaagggcaggcgtggcgaagaggaatccgagtccgaggagcaggagcaggaggaagccgggcagggataccacaccatccgtgcgcgggtgtcgcgcggcacggcgttcgtggtgccggtgggccacccggtcgtcgaggtggcatcccggggcagcaacctgcagatagtgtacttcgagatccatgccgacaagaacgagagggtgttcctggccggggcaaacaacgtcctcaagaagctggacgacacggctaaggagctggcgttcgcggcaagggcgagggaggtggacgaggtgctcgacgcccagcgcgaccagggcttcctcgccggcccggaggagagcagtcgtgaggagcgggaggaggaggaggaacacgaaggacgccgcggccccaaggagtgggagaaggaggaggaacgcgaagcacgccgtggccgcgagcagcgtgagaaggagaaagagcgtcgtggccacggacggcgcgaggaggtggcggagacgttcctgaggcttgctaccggccggctgtgaggccgtcttacgctgatcgatgatcgagcaagcaacaagttgagagctagtgagcccgagcagtgatacgctggaca

SEQ ID NO: 951 - DNA, 529 bp, Setaria italica
taacaaaacggaaactaaaaggaaagaactaaggaacgttaacgaggtctaagggtcgtagggtaggttggtacgtaggttgcttcgacgcccagcgcgaccagggcttcctcgccggcccggaggagagcagtcgtgaggagcgggaggaggaggaggaacacgaaggacgccgcggccccaaggagtgggagaaggaggaggaacgcgaagcacgccgtggccgcgagcagcgtgagaaggagaaagagcgtcgtggccacggacggcgcgaggaggtggcggagacgttcctgaggcttgctaccggccggctgtgaggccgtcttacgctgatcgatgatcgagcaagcaacaagttgagagctagtgagcccgagcagtgatacgctggacatgcaaatgcggcatgtagtagaataagtgtggctctctatgtatgctactgaggtcatgttcataaataaacaaatagcaagtgctctataaactgttgagtgcttctattaaaccttaaaaaaaaaaaaaa

SEQ ID NO: 952 - DNA, 302 bp, Setaria italica
ctgcaggattattgttgctagggtccctaaacatggatacttggatagccaattcataccactaatagacgtcatttacaaccaaaagaacaagacaacagagcaaacagcaagaggaaattgaattcattcctcgtgaattcaaaatatattccttacctccgaggagttgatccagatggaggaacaatagtcttcagcttaattactcgtttctttcgtcgccttgacttcgttcttgacgcttagaaaggagggatggtcctctttattgccaagctgacccttctaaagcttctcgg

SEQ ID NO: 953 - DNA, 109 bp, Setaria italica
ctggtggttgattatgtgtctacttttgggagacttagatgctctattatcatgtctcccaaaagtagacacataatcaaccaccagacacatcaatttaaaactaaaa

SEQ ID NO: 954 - DNA, 222 bp, Setaria italica
ttgtttctttattagtcttgaagggagaccgatttagttgaggccctgacttacagagttggccatcactcgacatctgatgattcaaccaagtacaggccagttgatgagatcgagcattggcgaacagcaagggatccaatttccaggtacagaaaatgggttcaggggaacgactggtggtctgatgctgaagaatctgaactaaggagcagagtgagg

SEQ ID NO: 955 - DNA, 174 bp, Setaria italica
gctttagtatccttgaaatgtctcgatgagagcgataaggagtaaaagacggtacaaccaccatcagatccccgcgcagcgcctagtcgatctcctggagggaggcaccgccgacgacgtcgccgccgctgctggtggcgccgccgccaccggcagcgcctagtcgatctcctg

SEQ ID NO: 956 - DNA, 215 bp, Setaria italica
ttttctttttgttttatttttaacgttttcccttttcttttccctttccctaaaccattgcaagtacagggccagagctgagaaagtcacacagtccattgaagaaaggtctgtctttgagatcatggtagtgcttctgagcgaattctttggatggaacaatcagcttgatggcaacaagcttgtagcctttttctctcaaatcgagacacaat

SEQ ID NO: 957 - DNA, 236 bp, Setaria italica
tttctttttgtttttatttttaacgtttttccctttttcttttttccctttttccctttttaaaccttttattttgttctaagtacagggccagagctgagaaagtcacacagtccattgaagaaaggtctgtctttgagatcatggtagtgcttctgagcgaattctttggatggaacaatcagcttgatggcaacaagcttgtagccctttttctctcaaaatcgagacacaat

SEQ ID NO: 958 - DNA, 183 bp, Setaria italica
tctttcttcttgcatatttcttccaataaccaaagcaaagagggaactccgcaagaaatatgcagatcatgaaggtagacttgatggtgccaacaaagttatagaggtgtatgaacgagcggttcttgcagttacttattcagtggacatttggtagacttgatggtgccaacaaagttatag

SEQ ID NO: 959 - DNA, 147 bp, Setaria italica
ggaagaaaaggaaatatcttcgtataaaactagacagaaacattctcagaaactgctgcgtgatgtgtgcgttcaactctcagagtttaactttctttcattcagcggtttggaaacactctgtttgtaaagctgcagtggatattt

SEQ ID NO: 960 - DNA, 205 bp, Setaria italica
tcaaagctctgcttctccctctgacccactcgtcgttccgagctcctgttgccttcctcttacgggagcagacacgagagtgatcagggttcagggcaggggcctgctgcttcgtgccttcgttccaaacctctgcgggccgtgtagccatggaccggggccggcgtcctgcacctgtgcgcctccgccgcgctgctcgtcgtcg

SEQ ID NO: 961 - DNA, 117 bp, Setaria italica
aaaacttccaattcttacagctaattaacagtccaaaacaccactcacactagactctagagatggctgacccagaatattttagtagtatttggatcctaaccagaagctagctag

SEQ ID NO: 962 - DNA, 146 bp, Setaria italica
cttttgcagtcttgttttgaacttcttcctgaaccatggtgtacaaggttcctcaagctgcacaaatgggcttctatggctcacgagggccatgaaatttcttcagagttttggtgtatgaatcagtgcatgcttgactcatagga

SEQ ID NO: 963 - DNA, 169 bp, Setaria italica
tttttttttcttttaagtttctttgttagtctagcagcttctgcagcggcttatgcacaagccgtgccaaagtgaggaaaaggaaacggcttcagtggagaagccagtgaaaagccgtcacacgaaatgaattggggcaacaagccacaaaaagcggcttcttcccgtc

SEQ ID NO: 964 - DNA, 197 bp, Setaria italica
catccagaaggaatccactcttcatcttgtcttgcgcctccgtggtggccttgttaactaagggatcaagacaagatgaagagtggattccttctggatgttgtaatctgccaaagtacggccgtcctccagctgcttaccagcgaagatgagcctctgctgatctggaggaatcccctccttgtcctggatcttgg

SEQ ID NO: 965 - DNA, 102 bp, Setaria italica
ttttaactcttctctgtctacagaattcagtttgtttctaaaattacctgctctaaatctccaacttactatcttggttacagaaaattcacctgcactacc

SEQ ID NO: 966 - DNA, 150 bp, Setaria italica
taaggtaatggcaaggaatttcggtatgtagatatcagccctgtagctggggaaggcaacaaaggcatacagatatatagtttagaatggattcctatgaatttattgctggaaaaacccaaataagtgctttcatgagcagtatttggg

SEQ ID NO: 967 - DNA, 166 bp, Setaria italica
aagacaaagcaagggagtgtttcagcgtcttcgtcgtcgcggccattctacagcttcatgccggtcggtccagttcgatgcgagagacccctgagcgagatcaaggccgacgtgtctgacggcgtcgatcttgaactgaagctatgaaaggagctcatcactgtga

SEQ ID NO: 968 - DNA, 167 bp, Setaria italica
taaagtaaaataagaaagtaatgcgattaatacattattgaaaatgtcaaggatagcagaatctgtctatgatgtttctcagccacaaaaaggaaaattaatacatagtaaactaaactaatctaggcaacttatttgcaattcccaatcatgtgatcttaagaatg

SEQ ID NO: 969 - DNA, 172 bp, Setaria italica
gtaggtccatccgtaaatccaggggcatcgcatctttatccatttggcaaaaacgctagttttgaaccaaaagaacggaaccgaaaagcaagttaaaagaaaggctttaccgatcatttcagcattaagtctacaagctgtttcatattttgcagattttaattgtcttgta

SEQ ID NO: 970 - DNA, 264 bp, Setaria italica
taagaaggtgagcctgaagacttggagcccctcattgctgatcttggtgaggtagacccattcatggcagcggattagagacaatggacaaacttggaggactccctttgcagtttgtgcacttcttgagctcatctattctacaaaattgttaaattctgtatggatatgtgatcagttcctgaatcacaagcttcatctggttactggccagcctgatcaagcttgtgattcaggaactgatcacatatccatacagaattt

SEQ ID NO: 971 - DNA, 180 bp, Setaria italica
taaaagggggaagtacgttacctaggttacccccctagtttacaattttagaatttagtttcaatgagagccacatttcctgtttctaacgctcggatcaaggctacagaaaggtttgaagcggcctacccaacagtcaaggagttggctcttgctggtcctcctggctctaaaactgtg

SEQ ID NO: 972 - DNA, 192 bp, Setaria italica
aggggacaggacgaatgtgacgagaggagtcaaacttgaaaagatcacagcataggatgcaggtgtgtctcgtaacccgtagtagtacaaggccattggcaaggaatacccggcaaaagcattaatgaagagccatccaagagctttcttgtccaattccttccacttcccactttcgaaaattagagcaaa

SEQ ID NO: 973 - DNA, 250 bp, Setaria italica
tacggttgtcttatttctaaaaggtttttctaagttctagttctagtcgtaggttggaagaaaggaatggaagcttatggattggctctgtcatgtcaccttttcttggagtatatagattgtagaagcatttggattgtatgattgaatatgcaacgtgtatatgcgtatatggtagtcgtttaatagaataacattatacacgtgtatatgcatatttttcccaccatataatcaaatttatttgaac

SEQ ID NO: 974 - DNA, 260 bp, Setaria italica
ttttttgttttttacttttttcttttttattttttagttttagttttctttaacttagtaatactctagtgtacagcgtttctgatggcactgcagagtttgcttgacagctggaatcaaaggagtttccttgacagctcaactgtcggtgatatcagaagaaccacgagcaggtgtgcgcgcggggcattactaccatccccaaagtataattctacgagactccatgcatgcataacaggaaggcaagaaggtatact

SEQ ID NO: 975 - DNA, 264 bp, Setaria italica
aaaatttacttctgtgactaacttagaatagacaatagcaatggctcctaccgcttgcttttgcttgtgcatcggcctcctcctgtggcaaagctctcgccagcttggagcagctgctgctgcttccagctccggctccggctccggcggctgtgagttcgcgttcgacatgctgcacccgctcgatccgattcggaagataagatcggaagcggggaccgtcgactacttcgacgaggcgaacagcagctcctctgtgcgggt

SEQ ID NO: 976 - DNA, 247 bp, Setaria italica
catgcagtatttccagcaaattcattgccggtgctacctgaccgcaatgactagtgcttcttcatcaatgccaatatttagattatttgatggtaaagtgttattgtagcagtgtaacctcaagccttttatttagtttcatttccattgttatatattttgttactctataacgcaattggtgatttgaacatgccagaaatcttattaaagaaagctagtcaattgtattattgtccgtttaaaa

SEQ ID NO: 977 - DNA, 297 bp, Setaria italica
tgacaatgttctcatcaacgatagaaaactgtcagatcttccaaagataagacagccaacgttgataatctggggggagcaggatcaggtttttccgatggagctggcgcataggttggagagacatcttggggataattctagattagtagtggtgaaaaacgctgggcatgcggccaatatagagaagtccaaagaggtgtgcaagagcatcgttgaatattttcaggaacaggattcaagtgcttcaacggggggaaggaggtgcagctgtactgattgcgggaaattctgaac

SEQ ID NO: 978 - DNA, 303 bp, Setaria italica
aaatactgtatgtatgttcctttcatgttgtttttgcaccatgtttctgatagatatgtatgctactgcatcgtaaatttcttacccatgtcaacactaatttgcttcagtttttttctctggctatattgcttcatggtttcatgacaaagctatttttttttaccatttccaggtgccagtgtatttgcaaacagtgaccaaaaagttgtgctttgctctgccgtggagtcatggcagcaaagatacgtgtcgtgatgaagtcttttacgagccaaagcaacaaagtctcagggtcttttt

SEQ ID NO: 979 - DNA, 320 bp, Setaria italica
gcacgaccgcactgttccagtttcattcatccaaatgatgagctggaaaacaggttttcagctgaaagcaatttttacggtggatctaatggatccataatatcagaagatacttttccaaactcttcacctctgaccctgggcaatgaaagaataaactctgatactcattgtgatgtaccagaagggagctcagcaaatacatcaacaggaaaatatatggattaccttcaaggagttgcctcaaagctgaaacatcttgtattttgtaaactaatttagtaaactaaggttagtactaacggttaaactttagttaa

SEQ ID NO: 980 - DNA, 322 bp, Setaria italica
aggaacgaattacaaaccgcctcagcatccaaaattgcctgaaactcagctgctggggtatcagttccatcccaaacataaaatgtccattcgccattactttcatggacatgaagaaccttgcatactaagtcaaaagtagtttcagactttaaactccttaactgcaattcaagttctttcatacctggaggattgtatgcaagccacatcctcatctgggtcaaaagttcattgtcatatttgctcccatgatatttcatagaagtctgatatgggctggactctgtagatactttcccttcaaatagggcgaatgaag

SEQ ID NO: 981 - DNA, 119 bp, Setaria italica
cagatggtgtcagtgcttgacacttccggtaaaattatagttacttcagatttgcaaaagtggaactcttttaccactgttacagcaattgagcctgttcaggttacaaactgtacaat

SEQ ID NO: 982 - DNA, 135 bp, Setaria italica
taaagaaaaacaaatagtaatagaagtgttgaagcgagatgcttcagcccttcagaacgacggcagtaatccatatcaaacgcaatgcccttgggagctacatttgcctagcgaacgtagttgacaccatttgaa

SEQ ID NO: 983 - DNA, 207 bp, Setaria italica
tggccagtagaaacaaagccaaagtaaaaacaccagctcgagtctcgtcacacgagttcacattgttaatccatggaatcccttaatccattgtttccagatattgcatttgtttcaggcctgtttgtttccttgctttctgttcgctgtcccaactgcaatcatacaaatgcaatatctggaatcccttaattccattgtttccaa

SEQ ID NO: 984 - DNA, 142 bp, Setaria italica
cggcagaagtgttggtagtggaaaacatcacaaggaggcttccagggagatgagttatgtaccacgtgcagactgtccttccctgcatgtggtacataactcatctcactaccaacacttctgccgatgatggctgccaggg

SEQ ID NO: 985 - DNA, 145 bp, Setaria italica
tatctccgactcagtctatactatggcggtgcagcagctggtgagcatcctggagctgcccaccgaagctgatccgttggcccagttgctggccggtctcgtccctgatcccggctgcagcggaggcgaagttgacgccggtgag

SEQ ID NO: 986 - DNA, 150 bp, Setaria italica
agccagcatggttcgacaacagcgtctcccagatgtcctgcagagatgatttatactgtgtgcttgaatcaactgaaaagtcacttcgggccacatcgtttcttactccaacacaaagcaattgtgtactcgtcgaggaatggacatgca

SEQ ID NO: 987 - DNA, 313 bp, Setaria italica
taagcaccaaccatccttggcacatgacatcaagcatttgggtacacaaaatacactcaagttaagcatcatccaaagtgtccttacactatagcggctactgactcagaaatggagcgagcatttgtcacatccgtctgacacgcacaggcacgaatgcacgatggagtacgtcgccgtggtgatcatgctgacttgaccagcccgttccgccgagactaacgagctacactggagctccgattgggccctcctgtgccactgctaagctaattcctctcctaatccatcccactaaccaattagaccttgg

SEQ ID NO: 988 - DNA, 365 bp, Setaria italica
gtgtgtgccttttctttttctttgacacggcttaagtcactcatgtagctttaacataagaagccttctcgttgtcgatgttaattagattactttttgaaggaccaaatccgcaggtgtcactttgcagatgttgtttccagttgttccacgaacaccccctcccctccctcatgcccgttcatccacgcgcaaacggccatttgacagtacaacactgtaacaattagcatggtttacttgcctggcaatgtgttaaagaaccagccggattgagtatttgagtgtgctgcggtaaaaagtgcatagttatttgttcaagggtaatgtctctatcaataccaaggattaccgcatatattaat

SEQ ID NO: 989 - DNA, 154 bp, Setaria italica
acaggtgaatcagacgtatattaatcaatgatgaggctactttggtgagatggaagatttatgcgatcagagttgtatcaacctatatgtgaaggaggtaaccgtgtgctgaataatcatatgatctgactctgatttagggaattgctcggaa

SEQ ID NO: 990 - DNA, 268 bp, Setaria italica
gggaagatgcacatggctgagaggcagtgggcagaagctgcgactgatttctttgaagcttttaagaactacgatgaagcaggcaatccacggagaattcaatgcctcaaatatcttgtccttgccaatatgttgatggaatctgaagtgaatccctttgatggacaagaggccaagccgtataaaaatgatcccgagatccttgcaatgacaaacatgatgtcattcttctggtacgctctttaattctttagtatttgtttatata

SEQ ID NO: 991 - DNA, 341 bp, Setaria italica
cacggtgaggtcggtgttgaagtactcgcggagctgggtgatcaccccatcggcgcccacggtccaggcgtgcacccagtacacaccccgctcctggtcgccgccctcggcgatgacggtcgacccgaaggcgtccacggagcgcggcgcgaagcggaagctgctgctgctgtttgatccgccgccggcgagagcgaggagcaccaggaacttagttaataaaaaaaacaaaaaaaaaaacaaaaaaaaaaaaaaaaaaaaaaaaaagagcgaggagacaaaccaaaggaaaacttaaagttaaaagaaaacgaaaaactaaaaagaaaactaaaaccaaa

SEQ ID NO: 992 - DNA, 191 bp, Setaria italica
  unsure (1)..(191): unsure at all n locations
tattggtgtgacctgggaagaagagatcagggagcgatgtaataatcaaactttatttcaaaatttagagatgagaattggtgttattttattgtattctgatgagtttatgaagattgaaataatatttcaggaaaatggctaattattgaaccaaaanaaanaaaactaaaaagaagaactacgaaccg

SEQ ID NO: 993 - DNA, 119 bp, Setaria italica
attacctcagcttgttggtgtgtttaagacagccgtgtaattacacgtacataacaacttagctaccacggtaagtggtgaaggaggaagtgctctgccgtctggttctcttttgcatt

SEQ ID NO: 994 - DNA, 197 bp, Setaria italica
tattcttgacctactgtccgatgctgcagagtgtgttcttcagcagtcagtgattaaaggtcttcaagaggtgccactttcaaatttcgcagatgctgagagcttagtttcacgtggtatgctgaagcgcagcactgctgcaacaagtgccaacagcaagtcaagccgatcacagtgcatcataacgatacgtggtt

SEQ ID NO: 995 - DNA, 449 bp, Setaria italica
aaggtaggtggcatcgtcacgggatgctgttctttggactacaatgatctcagcttatggcaaatttggtcgggtacaggatgcagtcagcttgtttgataggatggcacaattgggcataaagcaggatggcatagcatatcttgcagttttgtcagcttgtagccatggtggacttgtcagagagggttgtcactacttcaatttgatgtctgatggtcaaagctcagttaagatgcatcctgagcactacggatgcatggcagatcttctatgcaggagaggttacctagaagaagctcttgaattcattgagaatatgccatttgagtctagcattgctgcttggagtgcattacttaactcatctcgaatacatgggaacgccaagttgagtcaacttgcagcatcccgtttgatcaagcttgatcctgacgaaccacagaccg

SEQ ID NO: 996 - DNA, 295 bp, Setaria italica
aatgttgcttgaaggagtgcgtcatcaactggttctactactactacgattcaattgtcctgcgctgatcatcatcctaggttcaggggtgcttgcgtttttgccttaacttctccatcttctatgtgatccattcaactacagcagtgactttcaatgttgctggcaaccttaaagtaagacacgactatattctgggctgttgttctctccctgctccctccgctcgctgaatcaacatgcttttgtaggttgcggtggcagtactagtgtcgtggttgatcttccggaacct

SEQ ID NO: 997 - DNA, 357 bp, Setaria italica
cttgtgtgcgcaccaggaatctgtggctgagtcatagatgtcccatgaatttggtgacttatctgtcaaaccaagtccaccagttatgtatagtttctctgtgagagatgcagacacaaaatagcacctgaaataaagtaacagcgcatcagcaagtggtcgccaattttgtatcagatgctgtatatacaacttataaaacatgagatgctatatataggtactgagaaggtacatatggatactgcttaaggtaaatatgtgatgtcatatataaatatcaattaaaggaaaacatgggatgccaatgaacattgtcattagaaatacctaggtgtaggcattggagctgctgtg

SEQ ID NO: 998 - DNA, 155 bp, Setaria italica
gtggacatgccaggagattgcacataaccaacacctctggaccccatgatgtctcaggttccattgtaccagtcgttcaaccatggctaagagattctttatgctggaaagttgggaactatttctgaagactccacttaacaacacgacatagt

SEQ ID NO: 999 - DNA, 235 bp, Setaria italica
aatgctgcatcatgcgctagtgctactgttaatttgtgaggcattaagaaagaacaagtcggggagagtgaggattcctaatggcattaagaagaacaagtagcactagcgcatgatgcagatctggatgctgcatcatgcgctagtgctactgttaatttgtgaggcattagaagacaagtcgggaacttaggaatcctcactctgggatgctatcaagcagatctggatgctg

SEQ ID NO: 1000 - DNA, 505 bp, Setaria italica
tttttagctgagagaattgttctgttaacggtaattgggaacaaggtttgctttccagtttagctgttacgatattacatacagcgtaattgctgaacttttgtcttgttgaaaaatgaacaatattctttttgccaataactaagcgtatcattttgctgctaacctttagtttgaaatgcgtatctgtagagaaccaagtgctttggtatatgctattaagagatcatgtgaaaacaaagctgaagtggttgcacaggatgagaaggaaagtggtcttcgagcgacactaaacctgggtcacacatttggccatgtatgtattgccatcgatcatgtctagatttttatgttcagttaatttatactggcattgatagattttgggtgccaaaacctcatacaccttatcacaacagcatctatctgaattttagccaccttatgttattgcattgcaccacttattcactgatcctcacactcaattgacaggctaggtctt

SEQ ID NO: 1001 - DNA, 688 bp, Setaria italica
agccccatcttccacatggtgtccgcaacgcagaccaccctggctgcgaccgcccgcgtcgtggagctgaagctcggcgagcttggcatcgagtaccgcctgtccgcagccctgccggcgatggtctggcggcggcatcgagcggtgcctgtcggaggcgctggcgccgcatctgcatggcctcgccggcgcctggaacgacctcttctgggcggcgcaccctggcagccgcgcgatcttggacagctatgaggccgctctcgggctgcagccggagaagctggcggccagccgccgtgtgctgagtgagtacggcaacatgcttggcgcgaccgtcttcttcgtcctcgaggagatgtggagacgccggggagctaacgaggaggaacgggagaaatgcgcgtgggggtcatgttgggtctcggcccggggatcacggtggagacgatgctgctgcatgctgccggtagccaggacgaagactagaatatcaccgtcgtcacaccttcctaaatatacgtacgacagtacgagagagttgacatgcgcttggtctatttgtaatgagtgattgattggatgatttgaaacgtttccagttgagtctggatgatttgaaacttttccggttaagttaatatttcatatgtgcatgtttatgactaaaaaaaaaaaaaaaaaaaactag

SEQ ID NO: 1002 - DNA, 179 bp, Setaria italica
tgatacggaagcggattgctcagttctttgttactggctgtacggaatctgcatcgcacatcttcggatccacatgattgctgtcattggactatcttgtgattgaaagcccttccagctcacttctatcccagcagttcaactgcaatgctttggtcttcagttgctcaaaagcagat

SEQ ID NO: 1003 - DNA, 129 bp, Setaria italica
acacatggttacaggattacaagatgcaacgatggcatcctcacaaaaaaatgatgtattgatgccaacttttgacaggggaaatcaaatttgaatctgtctagataccttatgacagatttataattt

SEQ ID NO: 1004 - DNA, 129 bp, Setaria italica
aatttccagaaacaataattgtcttcatgcacaagcaaatacatgtcttgtgcatgaagacaattattgtttctggaaattcatatccaagcaaccagatatccagagctgaggatttcaataacgaag

SEQ ID NO: 1005 - DNA, 361 bp, Setaria italica
tgggtgctggattcttgggtaaaggttattctggtgatttgtgacgacttccttgatgtgaggtgttcacctcggagatggtattgctttgatgcattcttgattgctgctgctactactgcataaacctctacagccatatatgggtttatctagtattattgaccccgtttctagcttgttgctattaagagttgacatggcctacccgcttctcaggttcagccgactacgacttgaagatggatgagaagactagggtgttgaccttgctcaagttgcctgttggatatggagatccactcacttgatgcgctacgcttcgtaggtctttttctatgtttgatgcagtcctggcatg

SEQ ID NO: 1006 - DNA, 235 bp, Setaria italica
tttcatccagagatgaatgagcgtgaagccgctaacttcatggtacgaacatgtgttgatgcttacaacaagtggactactgcagggtatgacttgattcagtacttgcagcagggtattgagaaatagtttgtttctcgtttgtagatggtatatgttcgtgtacatcaattgtatgtagcaactaataccatctacaaaacgagaaacaaactatttctcaataccctgctgc

SEQ ID NO: 1007 - DNA, 135 bp, Setaria italica
aagcatagtagcgtacgatgagagattattataggtggccataaaagtgggcgtgagagacaagacaggtatatgatgataatggtacctgcagatctgcaggtaccattatcatcatatacctgtcttgtctca

SEQ ID NO: 1008 - DNA, 172 bp, Setaria italica
taatgatattggcagtgctcataatatggaacaaggggacaagcaagacatctaccagtttcgggccctaaattctcctcgaagtgatcacaggcaaaccgacagattctcaaagcgaactggagtccctgaaagctctcgctgctcgcccacccatcctgcacttgcatgg

SEQ ID NO: 1009 - DNA, 310 bp, Setaria italica
  unsure (1)..(310): unsure at all n locations
aataggaaccaataggactaggaataataaccggtttacaaccaattaggtacaaagtagaatggtcggcattgctacatccccttntataggataacggagaagcagaacagagtctcgataaccgacaggatgtgggcaaggctgctttcctcgaccaaccagccaagcttcctctgcaacaaagttgtcgaggaggcgaagaaggaagaggaaagaacggcccaacttatagatggctcgccgtcccatccgagaatataagcggacgttgacctcacttcgtagcactggagctggaacctgcggt

SEQ ID NO: 1010 - DNA, 379 bp, Setaria italica
ttattcacatctaaagaagttggtgctagaagctgtgcgaggcgaggatagtgagctggcatttgcaaagtttgtcatggaaagagctcaaatgctggaggatatgcgtgtcttagtggatggcagttgttcaagagatgttgttctaagtcgtttgtcttcggaagggtgtgtatcagcagatgctacagttctggtggagaggcacgatgggactgcatggaccttccagagagccattgacttgttgcagagtgacccatttggttgctgaacctggaggtattctcaaagaccttctcagatactttttcatgttgtattctgcatatcaagttgtattataattgttagccttagcccttcagtatagttaagg

SEQ ID NO: 1011 - DNA, 382 bp, Setaria italica
caagtcctgtggaggacagattcagggccgataccctgtgcttatgcctgtgactgcaaatgatgccgatccactggcagaaatcagtgcttatttcccatgaggctagtgaatctgactgcaggcttaggcctgccttcagtgctagcaacgcatcctggtcagtctcatttctgctcagcaatgcttgagtgcatgaagttggtgccaacaggagcagatggggcaagataagcaattttagaactggaaacattttgccctctggcactgaagaacattgaacaaaactaaatttagtgactgggtatgttccactcgaaataataagaatgctagtaaaatatatcattgacattaatcatcaatacaaagtttaata

SEQ ID NO: 1012 - DNA, 313 bp, Setaria italica
aaagaaataaaagaaaataaataagacttaagaacaactctcgcacccaaacattgtgcagtatcatggaagtgatctgactgatgatgcactttccatttatcttgagtatgtctccgggggttcaatccacaaattactaagagagtatggctcttttaaggaacctgtgattcgtaattatactggtcaaattactaagagagtatggctcttttaaggaacctgtgattcgtaattatactggtcaaattcttgctggtcttgcctacttgcatgggaggacactgtccacagagatatcaaaggagcg

SEQ ID NO: 1013 - DNA, 272 bp, Setaria italica
actgaagcagtttttttcatggatattagttgatatttttccgattcaggctccttcgttgttttgttgtttccactatcttctgcagctacttctggcttagcctctttgtcttttgtgttatcttcgttctgttctgcaattggtgcttccattcaaccaactagctggttgaatggaagaagttgttgttgctgcgagaaggcattcgccaaagctagctggttgaatggaagaagctgttgttgctgcgagaagatagtggaaacaac

SEQ ID NO: 1014 - DNA, 434 bp, Setaria italica
taacggtaacaaaagaacaaatacttaatacaatacaccggccgtgttcttacaacaacagtccgccctattgcagcagcaatacttggcgcatttgacattacagagcatcatggcacaacaacaccaggtgctttcaccattcagccgactatccttggctagccccgccgcatactggcaacaccaacagctgcttccattcaaccagctagccgtggagaatgcctacttgcagcaacaacagctgcttccactcaacccacttgctgttggcaacccgcgcttctggcaacaacaacagctactacgtgtcaacccattttcctgcgatgaaccccgcgcattctggcaacacagcagctattgcgtgtcaacccagttgctgcgatgaacccgcgcttctggcaacaacaacagctactgcgcatcaa

SEQ ID NO: 1015 - DNA, 380 bp, Setaria italica
tttgaaacccactagcagcctcttattagcaacaatggcagcaaagatatttgctctttttacgctccttgccctttcggtgagcgctgccactgcagtctttcttccgcagggatccctagctgctactgccgctattccacaatacctcccacatgtgacagccttgggatatgaaaatccaattgtgcagtcctacaggctacagcaggcacttgcagcaagcatcctaccatcatcggccatgttcctaccacaacagtcggccttatgcagcagcaatccctgtctcatctgacagtacagagcatcacggcacagcaacaacgcattctatcaccgttgaaccaactagccttgccgaacccgccgcatacttg

SEQ ID NO: 1016 - DNA, 508 bp, Setaria italica
ccggcgtctatgatgctgcagcaaccgtggacccgaccgttccagcagtactggactccaaggatgatgccgtttcaacaatgtcactgtggtgccatctcacagatcatgcagcaacagcaactaccgtccatgttcaacccgatggctacagcgatcccgcctatgttcttccagcagccctttgctggtgttccattctagatagatgtcctcatgctgtaacaataataaagctgacatgccatcgcatgtgaatcataacgaataagaaaagtgtcgaatcaatggctttccattcattatctaatatactcatcatgtgccttttccttgagaggcatgaggccttaatgaattattgtattagatatatagataaatttaataggtagaaatgcctatacataagacaacagatataaagtaattaaactaaaacctaacttaagttaagttattttaagtttttacggggtttttacttttttaaaaggtttttttacta

SEQ ID NO: 1017 - DNA, 367 bp, Setaria italica
ttaaaattacctaatagtctacctattatttacttagttttctaggtaagtctaaaaggtctaactacctattggtctagtcctaagtattgttttgcacttgtttgcacttcttgctctttgtgcaagcgccactactgctacctatgtcccattgggcgccatgaacccttgcatgcagtactgcatgatgcaacagccgtacgccgtgaacccatgcatgcagtactgcatgatgcaacaggcgcttgccatgggcagatttgcctcaccggcatccatgatgctgcagcaaccgtggacctcaccacttcagcagtactggactccaaggatgatgcctagcatgatgccgtttcaacaatct

SEQ ID NO: 1018 - DNA, 397 bp, Setaria italica
taattaaattacctaattagtctacctactatttacttagtatttctaggtaagtctaaaaggtctaactacctattggtctagtcctaagtattgttttgtcacttgtttgcacttcttgctttttgtgcaagcaccactactgctacccatgtcccatggcacttaccaccagtgacgacattgggcgccatgaacccatgcatgcagtactgcatgatgcaacagccgttcgccatgaacccgtgcatgcagtactgcacaacgcaacaggcgtttgccatgggcagatttgcctcaccggcgtctatgatgctgcagcaaccgtggaccttaccgttccagcagtactggactccaagggatgatgccgtttcaacatggcaccacagtgaca

SEQ ID NO: 1019 - DNA, 500 bp, Setaria italica
gagggttttgtatatatattcaattaaacttgagcaacatcttcactatgcgcccgttgtgtggctgcgctgtccatctagttaagtatgcttgttcggagctactttcccaattcttgatatttgtttcttagtacatacataatcaagtacgtctctgaaggtacgatgtacaatttttggtggttgatgactatggtacgaacaattacagaatacacttggacaacataggacaatagaatctcaaccaacacttttcttatttcttaggatcacatgagtcggcatgcaaactttattataaaagtacaacaaataattgatctagcaaaggccagaaccaatgattggttgctgcaagaaggtagcggcgttcatcgcagcaagtgggttgacacgcagtagctgctgttgttgccagaaggcggcggggttggtgatagctagttggttgaatggaagcagctgttgccggaaggcattcgccgcgtaagtct

SEQ ID NO: 1020 - DNA, 385 bp, Setaria italica
ttgaaaccgacaaccaacctcttagcaacaatggcagccaagatatttgccttccttgcgctccttgctctatcagtgagcgctgctaccgcggtccttgtaccacaggtgctcagtagccgccgccgcagccacaattccccagtacctctcaccttacacagctgttgggtatgaacacccaattgtgcaatcctacaggctacagcaggcgctcgccgcaaacatcttatcatcaccggcactccttcctacaacaaccatgggccctatcgcagcagcaatccttcgcacatgtgacagtacagagcaccaccgcacaacagcaacaatttctaccagcgtttctagcctaacttagtcccttagtcttagtccccgtcct

SEQ ID NO: 1021 - DNA, 457 bp, Setaria italica
tttttttttttaggatgccaataaaatcatctttgtttattatttatgataattcatgactattggcatgtgaaactttattattggagtacaaactcatacatcatttagaagatggcaccaccaatgaagggctgctgcaagtaggggtttgccaaagccacttggttgaacacgctagataccagttgttgttgctgccagtgggcgataggactcgtcagagctagttggttgaacacgtttggcagcaatcgttgttgttgccagtaggtagtggtgatggggttcaccgaagccacttggttgaacacgctggacaacagttgttgctgctgccagtgggtgataggacttgttagagctagttggttgaacacgtttggcaggaactgttgttgctgccagtaggcagcggtgatggggtttgccagagccatttggttgaagatgtttg

SEQ ID NO: 1022 - DNA, 347 bp, Setaria italica
tttaccgttaactttacttaagtttactttaatttaactttaatttgtctaaaccttaaactacttgtaaaagtctatttagtcaaacttcttcagcaaagatggcagctaagatatttgccttctttgctctccttgctctctcggcaagcgttgcttctgcgtacatttcaccagtgagtgctcttgccgcaaccgctagccccctatacttgccccaagctactactactctgttgccaaatgtgttcaaccaactggctttggcaaaccccattcaccgctgcctacctgcggcaacaacaattcctacctaacatcttcaaccaaatggctctggcaaaccc

SEQ ID NO: 1023 - DNA, 611 bp, Setaria italica
aacaaaacacagcctagactgccgttcaaaaccaaacggactaattaaacccagccgccatcttgcagcagcaactgtcaccattgaacccacttgcattggcaaaccccgccgccttctggcagcagcaacagctagtcaaccaactagctttgacgagtcccgccgccttcttgcagcaacccatcgttggttctgccctcttctagattactgatgagttgtacttgaataattatgtttgcatgaggacatgggtgactccgcggaaataagaaaagtattggttgagattatgaagtcctatctgtgtccaaatgtgtttcgtaattctttgtgccatacattcgacaactaccaaatactatgtatcgtacctatggagccatacatgatttaagtacatattacatcatgcaaataccgtgaggcggttcagtatctccgaaagttcagatttcaccagatgggatagcacagccacgccacgggcgcgtagtaggacttaagataacacaatggttgtttcgaatgttccataggagagagaattggtcaacatcactaattattattgtgcatgttatatgccagtatatctacatgtttac

SEQ ID NO: 1024 - DNA, 327 bp, Setaria italica
tttaggcaaaaccccctaacttgccaaagccacttggttgaacacgctagataccagttgggcgataggactcgtcagagctagttggttgaacacgtttggcagcaatcgttgttgttgccagtaggtagtggtgatggggttcaccgaagccacttggttgaacacgctggacaacagttgttgctgctgccagtgggtgataggacttgttagagctagttggttgaacacgtttggcaggaactgttgttgctgccagtaggcagcggtgatggggtttgccagagccatttggttgaagatgtttggcggcaacaacattcc

SEQ ID NO: 1025 - DNA, 420 bp, Setaria italica
tttcttatcactgctgcctacttgcagcaacaacaattgctaccaaacgtgttcaaccaactagcactagcgagtcctgtcgcccaattgcagcaacaacaacaactgcttagtgtcaacccactgggtgtgatgaatcccgccgctttctggcagcaacccatcattggctcggctatcttctagattaactatgagttgtacttctttaataaagtttgcatgctgaggagttttactcttaaacaaaacatttcttatttccgagagtcaaactcctcagcatgcaaactttattaaagaagtacaactcatagttaatctagaagatagccgagccaatgatgaatcccgccgctttctggcagcaacccatcattggctcggctatcttctagtacaactcatagttaatctaga

SEQ ID NO: 1026 - DNA, 394 bp, Setaria italica
tacctaactagtctacctattatttacttagttttctaggtaagtctaaaaggtctaactacctattggtctagtcctaagtattgttttgtctacttgttttgtctactttctttgtcttcttttgttgtctaagtcgtcctacttacttgtcttaccttattgttccctatttgggcgccatgaacccttgcatgcagtactgcatgatgcaacagccgtacgccgtgaacccatgcatgcagtactgcatgatgcaacaggcgcttgccatgggcagatttgcctcaccggcatccatgatgctgcagcaaccgtggacctcaccacttcagcagtactggactccaaggatgatgcctagcatgatgccgtttcaacaatctcactgtgg

SEQ ID NO: 1027 - DNA, 1116 bp, Setaria italica
  misc_feature (1)..(1116): n=a, c, g or t.
  unsure (1)..(1116): unsure at all n locations
tcgcccacttgcagcaacaaacacttgtggctagcgtgttcaaccaagtgcctttggcgaaccccatcactactgcctggcagcaacaacaattgctaccaaatgtgttcaaccaactagctttggtgaggacgtaatcatgcaagagccagtggaccacgccgccaaggacgaccgcgacgtcgtagtggtcccccgtcgaggccaagcaacgcggcagacgcggagccctagcgacggtcaccgggctccactcgcccccagcgtccgacgacacagtctgcacacggatgcaccttgcgcatgagcgggcctggtggagaccggccaggtcagcggcgagtagcaggaaggagcagccgatgccgatgccgtcggcggcggtgagcaggacgtacgtgcaggtagtgtagaggtggtcgtctcttccgacgtccggcggcaaggggaggaaggtgcggccgccggtcatggggtcgtacacgcacatgtcggattcgctgcgctccaggacgacaagctcgccgcgggatgtcagcgcgggatgtcacggcctcgtactcctgctccagtaggtcggcggcgctgcgcgacacgaagggcgcgaggctttcctcggcgaaggacgcggcggccggcgtcgacggggtggacgagggagaatgtctcgtcaaggaagccgagaagcctcggcggcacgacgccgtccggcgctctgcagatgcgacggacaaacgcagggctgaggatctcgcgccgaaagagcttagcttgcacgccgcgtcgcaccggaagagggtgtcggcttccgagcgcgcggcgatctcgaggatgagctctgccgggagcgtcaccgcggccgtcggtgacgacgtgccgcgcggagtgcatgcacggcgccgtttgtgcggcggcatggttcttcttgcgtacagccgtatacggtatccagtatccactactagtatttatagaccagcagattgggagtttgggacaggacaaggatggagatgccctcggtgcatattgggattggtgttgtcccgtcggcatgcaacttcatagacggtataggatggcacctcacgacaagtttgaggaccgctagtntta

SEQ ID NO: 1028 - DNA, 477 bp, Setaria italica
ctgtgttccacataaatggcagctgcatcgccatcctaatctgttgcaggtgcatcatctggcacattgcaccacagtggcactgtggtgacatcattccttgcatcatagactgcatgcaacactgttgctgcagcatggccaatggtgattgctgcatcaacattgctagcaagggtgagcctcctatggtgaatgctcgttgcatcatgcaagattgcatgcatgggaccatggaacccattcccataatcggtgagaatgagcttaccatggtgaatggttgttgcatcatgcatgattgcatgcatgggtccatcatgcctattcccatcattagtgggaagttttgcgggcatgtggctgtagtagtagcaactgcagaaagagcaaggagcacaaccagagcaatgcgtgatgccatggtattcgggtactatcacaataaaaatggaggtgttagtgagatggtacccg

SEQ ID NO: 1029 - DNA, 1501 bp, Setaria italica
tagttaacataagggaaaagttaaagaaggaacggaaaagggaactgtagacctattggtaaaactattgctagtcctaacttcttgtaagaataagcatctaactgaagtgttggagccatggaaaacattgcacctttccctggcaggacaactcttgttgccaatgttgctccagatgacgaggaccaggtctgcttgcaggcccaggaactcatgttcgcatacaacaactccctagtcctcagggcggccatccagctcggcctcctcgacgcgctctacgcggctcccacggcgctgaccgccgacgagctcgcggagcaaatcaaggccgcggacaagaccgaggcgaccgcctcggtggacaggatccttcgctacctcgcgtgcttcaacgtggtgaggtgctcgaccgagacgaccggcgtcggcggcgcggtcctgcggcggtacacgccggccccggtgtgccgttggctcaccaagaacgacggcaaggggtcgctggcccctttcgccgtgttcctcggcgacccggaccacatgttgccctggcaccacatagccgacacggtggtctccggtgggctgctgtcgtcgtcgttcgagaggaccaaagggatgccgttcttcgactacttggggaagaacaagcggctaggtacgctgttcgacaacgccatggctgagcactcggtgatcctggtcaccaagatgctcgagcgtttcagaggattcgacgatgttcgtctgcttgttgatgttggcggtggcacgggcaacacccttgagatgatcacatcccagtacaagcacatcaagggcatcaacttcgacctgcctcacgttatatctcaggccccatctcttcctggtgtggaacatgtggctggaaatatgtatgagagcgtaccctatggagatgcagttcttctgcagtggatcctccttatgcagaccgatgaacaatgtctcaagatcctgaagaactgccacaaagcactgccggaaggcgggaaggtgatcgtcatagacggcctccttcctgaaaacccagatgcaaattctccagctgcgaaggatgcgttcaccttggatatgtgtatgtttgtcctgttcaagggaaaggagaggacggaaagggaatttgccaagcttgcccgggagactggcttcactggggcaatccggacaacctacataatcttgaacttttatgcgatcgagttcaccaagtagaaattccagcatatatatgccagcatggtattgaataagagctgatatatagctcgcgtgtgtgcctcagaatatatgggttatctacgcccatgtatgtgtgtctttacggtgatatgttctatgaacaatgaaaacaaaaaatcaaaaattaaaaacaaaactaaacaaaggacacacagggagtaggtaagggtctattctaactttcgtaccttgtccttcttacgttttatttatttctttcttaggtccccta

SEQ ID NO: 1030 - DNA, 546 bp, Setaria italica
agtagtactaccattctcattttaaaaaccacaagcacaaagctcatcgcagagcagagaacccaaccaaccgattgagatggcagcatccgctctgaaccccttcgtcgccgcctgcctcgtggccctcgtcgtcgccgcaggtgcggcgcggatcgtgccggacactgccacgatggatccggacatgctgacgacgaggccgtgccacagcaacaacgggtggagcggccacctctgcaaggacgtgtgcggggctagcgggttcagccgctacgacttcaccctggccaacacggccacgggatcccagtccacctgctgttgctgccccaagggctacaagaacgcgtgcctcaacgtcaaggagtagtgggtgggtttgccgtcgcgtgcgcaggctgtgacgagccacagtgctcgtgtaatgtaaggggagtttaggcataatcaaagagaataaaagttaagcggcaacgtactgtgtctcgactacttaaaaaaaaaaaaaatagaaatactaacctaagtaataacaaaaaaaaa

SEQ ID NO: 1031 - DNA, 525 bp, Setaria italica
  misc_feature (1)..(525): n=a, c, g or t.
  unsure (1)..(525): unsure at all n locations
atgataagctcattctcaccaatgatgggaatgggttccatggtcccgtgcatgcaatcttgcatgatgcaacgggcattcaccataggaggctcacccttgctagcaatgttgatgcagcaatcaccattggccatgctgcagcaacagtgttgcatgcagtctatgatgcaaggaatgatgtcaccacagtgccactgtggtgcaatgtgccagatgatgcacctgcaacagattaggatagcgatgcagctgccatttatgtggaacacagcagccatgatgatgcagccaacctattggaggcagccctttcctagctgtgcctgctagatatatatatgtcttatgttgtacccaaggaataaagttcacataccatcgtgtgtgaatcaccagaaataaattattgagtatgatacatatattgtggtgaaaattcaaataaaaaaaaaaaaaactaaaagaactacaaccaaaaaaacacagggagtagnnnnnnnnnnnnnnnnnnnnnnnnnnnnn

SEQ ID NO: 1032 - DNA, 327 bp, Setaria italica
tagtgttcaaccaagtgggcgacaggactcaccagagctagttggttgaacacgtttggtagcaattgttgttgctgcaagtaggcagcagtgatggggttcatcgcagcaagtgggttgatgcgcagcagctattgcgtgtcaacccagttgctgcgatgaaccccaccgccttatggcaacaacaacagctactgcgtatcaacccacttgctacgatgaaccctgccgctttcttgcagcaaccaatcattggttctggtcttttctagatcaattatgaattgtacttctataataaataaggaagaaggaaattgttgattg

SEQ ID NO: 1033 - DNA, 1545 bp, Setaria italica
cgacggtcggcgccgccaccgtggaccgggttttcccggtgagcgccacgcttggaaacggccaggtcctcaccggtcaatctctctacgcccaggcggccaaacaaacaccaatggtccggctgttgcccagcgactgcactggcaacgacctggtgccggacaggatcatgggcaagatcgtcgtgtgcagtagcaatttcggagtttctccaccatacggcgttgcagtgcagagggccggtggcagcgggctagtttccgttgccaccgtggagcagcatatggacgggctcatggtccaggcgttcacccttccggctgtcagcctcagcgcccgtgaagccgaaaagctcgcggcgtacatccactcggaaccttacccggtggcgtcgtttcgcttcacctgcagcacggtcaccggcgagaaccgcgcgccgatggtagcgaccttctcgtcgcgcggacccaaccaactcgtccgcgagatcctcaagccggacgtcatcgcgcccggcacgaacatcctcgccgcctggcccggcgagtcgcccctgacacgcgccgacggcgacacgagaagatcaagcttcaacatcatctcgggcacctccatggcgtgcccgcacgtcgccggcgtcgccgcgttgctgaagaagaagcaccccgactggactccggccatggttcggtcggcgctcatgacgacggcgacgatgctcgacagccacggcaggcccatcacggacaacgcccgccccggcggcagcacgacgccgatggcggccggggccgggcttgtccggccgcagctagcgctctacccgggcctggtctacgacgccgtggagcaggactacgtcgacttcttctgcaccatgaactacaccaccgcgcagatccggatgtttgtgccagacttcgccggctgcacgaggacgctccccggcggcgtcggcgacctcaactacccgtcgttcgttgtggacttcagcaacggcaccgacgtccgtgtcctgacacgcaacgtgacgagggtctcggagggtccggagatctacactgtcagggtcgtggtgccggacgagctggtggcggtgaccgtcacgccggcgacgcttgagttcggcgagctgaatgagacgaagagctacaaggtcgtgttccagagcaagaacagctcggctggtgcgcatggcgcgggtagtaagatgcagttcgggcacatcgtgtgggaaaacgacgcgcatcgagtgaggagccccgtcgtgttcacctggaactgaacctgacggcggcctgttctgtttcaggcgctgaataaagtcaggccagcgcagacgtgttcgttacttgttggtggtgtacttcacatctggtgtccagtaataaaaggttgcatatcactgtatctaaactgctcgagttcaacgtcatgagacgcagagttcaacatgaatgaaagttgtagtgctaaactgctaatatgataccttcttcgtgtccgtaaagttctagtgctaaggtaaaaaaaaaaaaaaaaac

SEQ ID NO: 1034 - DNA, 2934 bp, Setaria italica
atggccgccgcgccgccgctgtccgccgacgccctcagcttcctcccgtccgccgccgcccccgccgccgccgcgccgacgccggtcgtcgccgcggcgtggggcgcggcgagggcggcggggtcggtgagggggaaggcggcgctcaggatggcgagaagaggaagtggcctggctccggtggttgggaggaggccacgccggccgcccctctccgtgcggtgcgacgccaccagccgggacggaaggattacgcaacaagagtttacggagatggcatggcagtcaattgtctcatcacctgaggtggccaaggagagtaaacaccagattgtggagactgagcatctggtgaaatccttgctggagcaaaggaatgggcttgcccggaggatcttttctaaggcgggagtcgataacacaaagcttcttgatgctacggagaagttcatccagaggcagcctaaggtactaggtgaagatcctggttcaatgttggggcgtgacttggaagctctgatacaaagagcaagggactttaagaaagagtatggtgattcatatgtctcagttgaacatctagtcctcggcttcgccgaagataagcggtttggtaaacaactgttcaaggattttcagattaccgtgaagaccttgaaattggccattgaatcaatcagagggaaacaaaatgtaattgatcaagatcctgagggaaagtatgaagctttggagaagtatggaaaggatctgacagctatggcacgtcaagggaagcttgatccagttattggaagggatgatgaaattcgaagatgtatacagattttatcacggagaacaaagaacaacccagttttgattggtgaacctggtgtaggaaaaacggctatagctgaagggcttgctcagaggattgtacaaggagatgtcccacaagctctgaccaaccgtcgtctcattgcacttgatatgggtgctttgattgctggtgcaaaatatcgtggagaatttgaggataggctaaaggctgttctcaaagaagttacagattctgacggacagaccattctttttattgatgagattcatacagtcgttggagcaggtgccacaaatggtgcaatggatgctggtaatcttctcaaaccaatgcttgggagaggagagctacgttgtattggtgcaacaacacttgatgagtaccgcaaatatattgagaaagatccagcccttgagcggcgcttccaacaagtttatgttgatcagccttcagttgaagatacaatctcaatactacgaggactaagagagagatatgaactgcaccatggtgtacgcatatctgacagtgcccttgtggctgcagctgttctttcagaccgttatatcagtggacgattcttgcctgacaaagcaattgatctggttgatgaatcagctgccaagttgaaaatggagataacatcaaaacctactgctctggatgagattgatcgtgctgtcctgaagcttgagatggagcgtctctcacttacaaatgatacagacaaagcatcaaagggcagacgatcacgcattgaagcagaactatcactcttgaaggataaacaacgtgaattgactgagcagtgggagcatgagaagtcagtgatgactaaaattcaatctatcaaagaagagattgacagggtaaatgtggagatacagcaggcagaacgtgagtatgatctcaatcgcgctgctgaactgaagtatggaagtctgaatgccttgcagcgccagcttcagacaacagagaaggagctagatgaatatcagagttctgggaaatccatgctaagggaagaggtgactcaagatgatatagcagagatagtgagcaggtggacaggcattccagtctctaaactaaagcaatccgacagagagaagttgctgtatctggaggaagagctgcacaagcgtgttgttggtcaagatcctgcagtaaaagcagtctcagaggctattcagagatccagagctggtctgtctgacccaaaccgtcctattgccagtttcatgttcatgggacctacaggagttggcaaaactgagctagcgaaagcccttgctgcttttatgttcaacactgaggaagctgttgtaaggatcgacatgagtgagtacatggagaagcattcagtctcaagattgattggtgctccgccaggttacgttgggtatgaagagggtggtcagctaactgaggcagttcgccggaggccatattctgttgttttgttcgatgagattgagaaagctcattcagatgtcttcaatgttttccttcaaatattagatgatggtagggttaccgactcccaaggacggaaagtgagcttcaccaacactatcattatcatgacgtccaacgttgggtcgcagtacatactaaacatggacgaagaaggtggatcatctgattcagcctacgagaacataaagaagagggtgatggatgctgcaagatcagtattccgccctgagttcatgaatcgtatagatgagtacattgttttcaagcctcttgagagagaacagatcaacagcatcgtcaaattacagctggcaagagtacaaaagaggattgcagatcgcaagatcaagcttgaagtctcacctgcagcaatcgaattcctaggaagccttgggtatgacccgaactacggtgcaaggccagtgaagcgggtgattcaacagtacgtggagaacgaacttgcaaaaggcatcctcagaggtgatttcaaggacgaggacagcatcgtggtagacacccaggtcacagtgccatctaatggccagcttccgcagcaaaagcttgttttccgaaaggtcggtgagcaatcgaaggccgctgctgaagacgagaagttcttgccggctgtgtga

SEQ ID NO: 1035 - DNA, 1078 bp, Setaria italica
atggccgaccgcctcgccgccgccgccgccaccttccgcgcctcggccgtcgccgccccgtccgcccgccgtggcgcgcgggccagccgcgccttcttacccaactcgtcggcctcgccagctggcgcgcgcgtcggcctccgcgccgcgccatctcggctcccgcagaaggcgagggcggtgaggtgcgcggctgtggcggcggcgtccgacgcggcgcagctgaaggccgcccgcgaggacatcagggagcttctcaggacgacacattgccaccccatcctggtccgtctgggatggcatgatgctggtacgtatgacaagaatattgaggactggccacaacgaggaggagctaatggaagcttaagatttgatgttgagctgaaacatggagccaatgctggcctgataaatgctctaaagcttatccaaccaattaaggacaagtacccgggtatcacttatgcggatttatttcagttggcaagtgctacagcaattgaggaagctggtggcccaaagattccaatgacatatggacgggttgatgttacaggacctgagcagtgcccgccagaggggaagcttcctgatgctggcccaacttcacctgctgatcacttgagggaggtattctacagaatgggccttgatgacaaggacattgttgtcttgtctggagcacatacacttggaaggtccaggcctgaacggagtggctggggaaaaccagagacaaaatataccaaaaacggtcctggtgcacctggtgggcaatcatggacacctgagtggctgaaatttgataacagttacttcaaggagattaaagagaaaagagatcaggatcttctggtcctacctacagatgctgctttatttgaggacccagcgttcaaggtctatgcggagaaatatgcagcggaccaagacgcattctttaaagactacactgagtctcatgctaaactgagcaatctgggtgcaaagttcaatcctccacagggattctctctggatgattagtgctgcacctgagacagcccgtgaagcaggctcatactctcctagaaaa

SEQ ID NO: 1036 - DNA, 1437 bp, Setaria italica
atggcggagcgcctcgccgcctccctcctccccgccgcctccccctccccgtccgcccgccgcgccacggtcgcggcctcggggtccgccgccgcgtccttcccttcctcgtgctccgcccgagcggggctgcgcctccgctcctcccgctcggggtcggcccgcttctccaaggcggctgggcgcggcgggggaggcggcgcgctgcgggtggtccggtgcatggcggcgtcggacgcggcgcagctcaagagcgcgcgggaggacatcagggagcttctcaagaccacgtactgccaccccatcatggtccgtctggggtggcatgattctggtacctatgacaagaatattgaggagtggccccagcgaggtggagctgatggaagcttgagatttgaacctgagttgaatcatggagccaacgctggtctgattaatgccttgaagcttatccaacctatgaaggacaaatacccaggtatcacttatgcagatttgttccagttggcgagtgctacagcaattgaggaagctggtggcccaaaaattccaatgaaatacggacgggtggatgtcacagaacctgagcaatgtccacctgaggggaggcttcctgatgctggcccacgtgatcctgctgaacaccttagggaggtattctatagaatgggtcttgatgacaaggaaatcgttgcactgtctggagcacatacacttggaagagcaaggcctgaccggagtggctggggaaagccagaaacaaaatatactaaggatggccctggtgaacccggagggcaatcatggacagttgaatggttgaaatttgataacagttacttcaaggacatgaagtttctgagccagcttccatcgaaagagcagaaggatcaggatcttctagttttgcccactgatgccgcattatttgaggatccatctttcaaggtgtacgcagaaaagtacgcagaggaccaggaagccttctttaaagactatgctgaggctcatgctaaactgagcgaccttggtgcaaagtttgatcctcctgagggattctcactggacgatgacacaagcgatgagccagcagctgaaaagaaggaagaagctgcaccaacaccggaaccggcagctgcagcagcacctccgccagagccagcagcagcaccggcactggaaccagtagcagcagcagtagcaacagcgacagcggacgacaacaatggcgtggcgccacagccggagcccttcgtcgctgccaaatattcttatggaaagacggagctgtcggattcgatgaagcagaagatccgggcggagtacgaggggttcggaggcagcccggacaagcctctgcagtccaactacttcctcaacatcatgctcctcatcgcggggctggcgttcctgacgtctctggtcggcaactga

SEQ ID NO: 1037 - DNA, 936 bp, Setaria italica
atggccgtccaccacctcctccgccgcggggtctccggcggcttcccgctccacccgctccgcggcctcctcgcctcccaggagctcgggcggcgtccgttgagctcggcggcaggggatgcggcggccgagctgaggggcgcgcgggaggacgtcaagcagctgctcaagaccacctcctgccatcccatcctggttcgattgggttggcatgatgctggtacctatgacaagaacattgctgagtggcccaagtgcggtggagctaatggtagcttgagatttgaaattgagttaaagcacggggctaatgctggtcttgtgaatgctttgaagctgatccaaccgatcaaggacaagttttcaggtgtcacatatgcagatctctttcagcttgccagcgccacagccattgaggaagcaggtggccccaaaattcccatgatctatggaagggttgacattactgcccctgaacaatgcccaccagaggggaggcttcctgctgccggtccaccttcacctgcggaacatttgcgtgaagtattctatagaatgggcctgaatgacaaggaaattgttgcactatcaggagctcatacgcttggacgggcaagaccagaacgtagtggctggggcaaaccagaaacaaaatacactaaaaatggacctggggcacctggggggcagtcttggacatctcagtggctaaagttcgacaatagctacttcaaggatgtcaaagaaaggcgggatgaggaccttctagttttgcctactgatgctgtgctgtttgaggattcctcattcaaggtctatgctgaaaaatatgctgaggaccaggatgcatttttcaaggactatgctgaagctcatgctaaattaagcaaccttggggcaaaatttgacccaccaaagggtatctctcttgagtag

SEQ ID NO: 1038 - DNA, 1812 bp, Setaria italica
atggaatccctagccgccgcctccgtgttctccccctcccgcgtcgccgccccggcggcgggggccctggttcgggcgggggcggtggtgtcggccgggatgaggaggaggagcggcaggagcggcggcatgaggtgccgcgccgtgacgccgctggcgagcgcggtgatgagcaggggcgccgtggcggcgaaggcggcggaggaggagaagaggcggttcttcgaggcggcggcgcgggggagcgggaagagcaacctggtgcccatgtgggagtgcatcgtgtccgaccacctcacccccgtgctcgcctaccgctgcctcgtcccggaggacaacgtcgacgcccccagcttcctcttcgagtccgtcgagcagggacctcagggcaccaccaacgtcggccgctacagcatggtgggagcccacccggtgatggagatagtggccaaggagcacaaggtcacgatcatggaccacgagaagggccaggtgacggagcaggtcgtggacgatcctatgcaggtgcccaggaacatgatggagggatggcacccacagcagatcgacgagctccctgaatccttcacaggcggatgggttgggttcttttcctatgatacggttcgttatgttgagaagaagaagctgccattctctggtgctccccaggacgacaggaatcttcctgatgtgcatttggggctctacgatgatgttcttgtcttcgataatgttgagaagaaagtgtatgtcatccattgggtaaatgtggaccggcacgcatcaattgaggcagcgtaccaagatggcagatctcggctggaccagttgctgtccaaagtgcacaattctaacgtccccacgctctctccaggatttgtgaagctgcacacccgccagtttggtacaccgttgaacaagtcaaccatgacaagtgatgagtacaagaatgctgttatgcaggctaaggagcatattatggctggggacatcttccagatcgttttgagtcagaggtttgagaggagaacatatgccaacccatttgaggtttatcgagctttacgaatagtgaaccctagcccatacatggcgtatgtacaggcaagaggctgtgtcctagttgcatctagccctgaaattcttacacgagtcagtaaggggaagattattaatcggccactagctggaactgttcgaaggggcaagacagagaaggaagatcaaatgcaagagcaacaactattaagtgatgaaaaacagtgtgctgagcacattatgcttgtagacttggggaggaatgatgttggcaaggtctccaaacctggatcagtaaaggtggaaaagttaatgaacattgagcgatactcccatgttatgcacatcagctccacggttagtggacagttggatgatcgtctccagagctgggatgccctgagagctgcattgcctgtgggaacagtcagtggtgcaccaaaggtgaaagccatggagttgatagacgagttggaagtcacaaggcgaggaccatatagtggtggtttaggagggatatcatttgatggcaacatgcaaatcgcacttgctctccgaaccattgtattctcaacggcaccaagccacaacacgatgtactcatacaaagctgctgataggcgtcgggagtgggttgctcatcttcaggctggagcgggcattgttgctgacagtagcccagatgatgaacagcgcgaatgcgagaataaggctgcagcattagctcgggctatcgatcttgcggagtcagcttttgtagacaaggaatag

SEQ ID NO: 1039 - DNA, 741 bp, Setaria italica
atggcgtcgttgcacctgactgggccgcgggtggcggtggccgcgaagccggccgcgctgggcgggctccgcctgccgacgccgtcgattgccgtgccgacggggcggagggcccgggggctcgtggtgagggccgccaccgtcgtgtcacccaagtatacttccataaaaccattaggagacagagtacttgtgaaggtcaagaccaccgaggctaaaactgatggagggattttacttccagtatcagttcagtcaagaccaacaggaggggaagttgttgctgttggagaggggagaagttttggaagtaacagcatcgagatcagcgttccggttggtgcacaagttgtctactcgaaatacgccggcacggaattggaattcaatgacgccgaccatctcattttgaaagaagatgacatcattggtattctcgacagtgatgatgtgaaagatctgaagccgctgaatgatcgtattctgattaaggttgctgaagctgaagaacaaactgctggtggtttgctattgacgcaggcgaataaagagaaaccttctgttggaacagtggtagctgttggccccgggccgttgggcgaggacggcacaaggaaggccctgtcgatcactcctggaagcaacgtgatgtacagcaagtacgccggaagcgagttcaagggtcaggacggcgagtacatcgtgctcagggcatccgacgtgatggctgttctttcctaa

SEQ ID NO: 1040 - DNA, 822 bp, Setaria italica
atgggggcactacccgtcgcccacaagctcgctctcacctcccccttcctcccgcgccaccgccgaccctgccccgccgcccaccaccacgggcagcgccggcggcgacatggagtggtggtggcgtacatggagccgaaccccaattcgccggcggccatcgcggggcgcctcgtcggggcgctccccgtggtgggcctcgttgcgcgcatcctgagtgacgagggcggcgtcggcggcgacatcatcgacttcgccgagttccgccgccgcgtcagcaagaagtgcaccgtcatggactcccaggccttctacgacttcaacgagcgccgcggcaagccgggggatcccttctacgtcctgctgtgctgctggctcgccgccgtcggcgccgggctactcaagacagaggagatcttggaaggcgtggcgcggctccgcatttccaacgacatcgagttcgaggaggagaccttcattgacatgatcaggacggcaaaggagaaacgagcaaagctgaaggctccagctccgcagataccgatggaaacgcgggcggagaaggcccttgaagccatctacgtctgctgcttcgggcaggacatggttgaggaagaggacgagaagcttctccgcacgatactgaacgctgtcttcccctccgtcgggaggccggcgatcgagaggatggtggcgtccatggccaagcaggtggcctccggcgagaggaagcgggacgggaggaccgtgtccaaggaagttcagcagcggcagctcaaggacctacagtttctcaaacagaacaagctggactctgcatga

SEQ ID NO: 1041 - DNA, 2850 bp, Setaria italica
atggaggtgtgctgctgctcgacctcgtcgtcgtcgtccgtcctcaccgtgggccacggcggcgccgcgcggatgctggcggcgccggcgggtcggtggggcgcggcggcggggttcgggagggcgatggtgctggcgcaccagctcccgctcccgcacccgctcccgcgccgggcgtcgtcctcgaggccgtccccgcggcgggcgcggaggggcctgatcatggcggtgttcgagcgcttcacggagcgggccgtcaaggcggtcgtgctgtcgcagcgggaggcccgggggctcggggaggccgccgtggcgccgcgccacctcttcctcggcctcgtcgcggaggaccgctcgtccggcgggtacctctcgtcggggattggcatcgagcgcgcgcgggaggagtgccgcggcatcggcgccagggacgtggacgcgccgccgccgccgccgcccaagaccggatcggggctcgacaccgacgtgcccttctccgcggccagcaagcaggtcttcgaggtcgccgtcgtgctgtcaaagaacatggggtccagcttcatctcgccggagcacctcgccatcgcgctcttcaccctcgacgatcccaccaccaacaacctcctcaggagtttgggagcagatccgagtcagctttcatcagttgcagtcgaccgtctccaagcagagcttgcgaaagatggaagagatcccgcaggagcatcatctttcaaaatcccagagaaggctcctgcagcagctggaagatctgctttctcccaatccttgactaaaaagaaagggaagggtgcactagatcagttttgtttggatttgaccacacaagctagtggaggtttcatcgatcctattattggccgtgaagaggagattgaaagagtggttcagataatatgccgacggacgaagaacaatcctattcttttgggtgaggcaggagttggcaaaactgcaattgctgagggactggctcttcgaattgcaaatggcgatgtccccatttatcttgtggcaaagcgtatattgtcactggatgttggtctacttatcgctggtgcaaaagagaggggtgaattggagtctagggttactaatataattcgtgaagtccgggaagcaggcgatgttattctttttattgatgaggttcacaatcttattggatctggaaccgttgggaagggtaagggttctagccttgatattggcaacttgctgaaacccgcgcttgctagaggtgaactgcagtgcattgcagcaacaactctagatgaacaccgaatgcattttgagaaggataaggctttggcccgccgcttccagccagtattagtagctgagcctagtcaggaagatgctgtgaagatattgcttggtcttcgtgagaaatacgaaacgtaccataaatgcagattcacattagaagccatcaatgcagcagtttatctatcagcaagatatatccctgacagacagcttcctgataaggctattgatctaattgacgaggctggaagtagagctcggatggagtcatttaacaggaagaaggaagggcagtcttcaattctcttgaagtcaccagatgaatattggcaagagataagagctgcacaggccatgcatgaagtggtgttatctaacaaggaaaaatattctccaaatgcgaatgatcaagagagtggtaatgctgatgttgaagcaccatatgaagacaatagagggtcaacatcaacctcatcactctcagctgatgagccaattgtagttgggacagaggaaattgcaagagttgcctcattatggtcagggataccagttcagcagttgactgctgatgataaaaagcttctagtaggactagatgatgagctcaggaaacgggtcattggccaagatgatgcagttgtggccatatctcgtgcagtgaagagatcgcgtgttggccttaatgaccctgacagacctattgctacactgcttttctgtggtccaacaggagttggtaaaacggagcttaccaaggctctagcagcaagttattttggatcagaatctgctatgcttagattagacatgagcgagtatatggagaggcacactgtgagcaagctgatcggctctcctccagggtacattggatatggtgaaactggtactttgacagaagcggtcaggaggaaaccatttactgtggttttgctggatgagatagagaaagcccaccctgatattttcaacatccttctccaaatctttgaggatggacatttgacagactcacagggccgcagggtttccttcaagaatacattgattgtgatgacgtccaatgttggttctacatcaatttcaaagggaagacggagcataggtttcttgaaggaagatactgagtcaagctcatatgtcgcaatgaaatccctagtaatggaagagctgaaggcatttttccgaccagagttgctcaacagaattgatgagatggtcgtgttccgtcctctagagaagactcagatgctggccattcttgatatcatcctgaaggaagtgaagggcaggcttttggcccttgggataggcttggaggtgtctgatgcaatgaaggacctgatctgccaagaggggtacgacaagagttacggtgcgcggccgctgcggagggctgtcacccacatgattgaggatgtcatcagcgaagcgattcttttcggcgaattcaagcccggcaacaccatactgatggacattgatgccgaggggaagccgtgcatgagccatctggaccaacagatcgtccaggtcactgacccaacacgggcattctga

SEQ ID NO: 1042 - DNA, 894 bp, Setaria italica
atggagctccgcctctgccttcgtctccacgcgcgcctcccaccagccacgacgccgcccccgccgcctttcgcggcgcccgcggtgctccccgcgtcccgccgaattcggactggtgggagctacggggttgctcttcggcggcccacgaggcgttcgaatccggcgattcgcgcttccgaagccgacggcgcgccgggtgtggctgtgaaggagaggagcgtctcggtgatcctcttgtccggagggcagggaaagagaatgggggcaagtatgccgaagcagtatctgccactactgggactaccaattgcattgcacagtttgaaaacattctgtcaactgaaggaaatgaaagaagtcgtggtagtgtgtgacccagactatagtgatgtatttgaaggttctattgagaacttgcaaatacctcttaaatttgcatgcccaggaaaagagagacaggactctgtttttaatggacttcaggaaattgatggggattcggaacttgtttgtgtccatgattctgcaaggcccttagtttcttctgaagatgtaaaaaaggtcttacaagatgctgctgtgcatggggcagctgttcttggtgtgcctgtgaaagctacaataaaggaggctaatagtgattcttttgtcgtaaaaacccttgaccggaaaactctatgggaaatgcaaactccacaggttatgaagcctgatttactcaaagctggttttgagcttgttaaacgggatggccttgaagtcaccgatgatgtatccattgtagaatatctcaagcaccctgtctatattacggaaggctcttacacaaacattaaggtgaccactccggatgacatgcttctggctgagcgcctgatgagtgggaaatga

SEQ ID NO: 1043 - DNA, 2367 bp, Setaria italica
atggcgccggcgctgagcgggaccctgggcgcgtcgtcggtggcggcgctgcggccctgcgcggagaggagggcgccgtccgccgcgagctcggtcgctccgcgggggagcggggcggtgaggtgccccagaggggtcagatgggaggccgagaggagcagggggagattggtcacggtgaggtgcgacgcggccgtcgtggagaagcccgccggggaggaggcggccgaggagaagttcgagtaccaggcggaggtgagccgcttaatggacttgatcgtccacagcctgtacagtcacaaggaggtatttcttcgggagcttgtcagtaatgccagtgatgcattggataagttgaggtttcttggcgtgactgattctgctttacttgctgatggtggagagctggaaataaggattaagcctgaccctgatgctggaacaattactatcactgatactggtgttgggatgaccaaagatgagctcaaggattgccttggtacgattgctcagagtggcacctcaaaatttttgaaggccctcaaggagaacaaagaccttggggctgacaatggtctaattggtcagtttggtgttgggttttactcggcttttcttgtagcagagaaggttgtggtgtcaactaagagtccaaaatcagataaacagtatgtgtgggaagctgtggcggacagtagctcttatgtcatcaaggaagagactgaccctgagaagatgcttactcgtggaactcagattactctctttttaaggcctgatgacaagtatgagtttgctgacccttcaaggattcaaggcttagtgaagaactactctcagtttgtatcattccccatatacacgtggcaggagaaatcaagaactgttgaggttgaagaggatgaagagccaaaagaaggtgaagaggcaacagagggtgagaaactaaagaagaagaagactattactgagaaatactgggactgggagctggctaacgaaacaaaacccatttggatgagaaatccaaaggaaattgagaaaactgaatacaatgagttctataagaagacattcaatgagttcttggatcctcttgcccacactcacttcacaacagagggtgaggtggaattcaggagtgttctgtatgttccaggaatggcacccctcagtaatgacgagataatgaaccccaagaccaaaaatatccggctgtacgtcaaaagagtcttcatctctgatgactttgatggtgaactgtttccaagatacttgagctttgtgaaaggtgttgtagattcaaatgaccttcccctcaatgtttctcgtgagattcttcaagaaagtcgaattgtaaggattatgcgcaagcgacttgtcaggaagacatttgatatgattgaagagcttgctgaaaaagaagataaggaggactacaagaagttctgggaaagctttggcaagtttatcaagcttggttgcattgaggacacaggaaatcacaagcgccttgctccattgctgcgtttccactcttctaaaaatgagggtgatacgataagccttgaccaatatgtagagaacatgcctgagagtcaaaaggcgatatactacattgctacagatagtctccagagtgcaaagactgctcctttcttggaaaagctggtccagaaagacattgaagttctctaccttattgagccaatagatgaggttgctattcagaacttacagacctacaaagagaagaaatttgtggatatcagcaaagaggatctggaattgggtgacgaagaagaagaaaataaagaaacaaagcaggaattcacactcctgtgtgactgggtaaaacaacagcttggtgacaaggttgcgaaggtccaaatatcaaagcgtctaagttcatcaccgtgcgttcttgtatctggcaagtttggttggtctgccaacatggaaaggctcatgaaggcacaaacgcttggtgacacgtcaagcttggaatttatgagggggaggaggatttttgaaattaaccctgaccaccctattatcaaggatttgaacgctgcttgcaaaaatgagcctgaaagcacagaagctaagagggcggtcgagctgttgtatgaggctgctttgatctccagtggatatactcctgagagcccagcagagttgggtggcaagatctacgagatgatggcgattgcccttggtgggcgatgggggaggtctgacacagaggaagctgaagcaagtaatgatgaggccagcgtaggggcagacgcatctgaaggcactgtgacggaggtgattgagccttcagaagtaagacccgagagcgacccgtggagggattag

SEQ ID NO: 1044 - DNA, 1152 bp, Setaria italica
atgatttcgccgccgatgccgacgcatctcctcccgacgcggacgatctcccctcgctcaaatggctgcgcagcgacagcgagcccctctcccccctcgatggctgcgcggccgcggcgactcccttcagggcttcaatctgtgactggcagagggaagttttcactggcagccatcactcttgatgattatcttccaatgcgaagtactgaagtgaagaaccggacatcaacaggtgacatcacaagtctcagactaatcaccgcagtcaaaaccccctatctgccagatggaaggttcgatcttgaagcatatgattctctcataaacatgcagatagagggtggtgctgaaggtgtaattgttggaggaacaacaggagagggtcaccttatgagctgggatgaacatatcatgctcatcgggcatacagtgaactgctttggcactagaattaaagtgataggcaacacaggaagtaactcaaccagagaggctgttcacgcgacagagcagggatttgctgttggcatgcatgcagctctccacatcaatccttactatgggaagacctcaattgagggaatgatctctcattttgaggctgtcctcccaatgggtccgaccatcatctacaatgtgccatccaggactgcccaggatatcccccctgaagttatcatggcaatttcaggctatccaaacatggcaggtgtcaaggaatgtgttgggcatgagagggttaagcagtacactgacaaagatatagcagtatggagtggtaatgacgacgaatgccatgattctaggtggaaatatggtgctactggagtcatttccgtcgcaagcaaccttgttcctgggctcatgcacagcctcatgtacgaaggcgagaatgcgactctgaatgagaagcttttgccgctgatgaaatggttgttctgccagccaaatccgattgctctcaacactgctctggctcagcttggggtgacaaggcctgtcttcagattgccgtatgttcctcttcctctcaaaaagaggattgagttcgtccggattgttgaagctattggaaggcagaactttgtgggacagaaagaggcgcggattcttgatgatgatgatttcgtgttgatcagtaggtactag

SEQ ID NO: 1045 - DNA, 2020 bp, Setaria italica
aatgcagatgcagcagaccctcacgctgcggggcgtcccctccgcccgccgcgccgcgccgccgccggccagctccgcccacctcgggtcctctccctgcctgctgcgggtcccccgctcgctccgacgacggaggccccgctccctcagggcctccgcctcgctcgagcaggaggtcaaggaagtcgccgcctccccggctccctccgcagggaagagtactcaagcaactagaagggatgtgaggaatatagcaattgttgctcatgttgatcatgggaagacaactttggtggattcaatgttaaggcaagccaaggttttccgggataatcaagttgtgcaggaaagaataatggattccaatgatctggaaagagaaagaggaatcactattttgagcaagaatacatcaataacctataagggtactaaaatcaatataattgatactcctggacattcagatttcggcggggaggttgagcgtgttctcaacatggttgaaggagttcttctagtggttgattctgtagaggggcctatgccacagacaaggtttgttctgaagaaagctctagaatttggacatgcagttgttgtagttgtaaacaagattgacagaccagctgctcgtcctgagtttgtggtgaattcaacatttgaactatttattgagttaaatgcaactgatgaacagtgtgatttccaaacagtctatgcaagtggaattaaaggaaaggctgggttagatccagaaaatttggctgatgacctaggacccctttttgaggctattctaagatgcatcccagagccacgcattgagaaagatggtgccctgcaaatgcttgtatctaatactgaatacgatgagcacaaaggaaggatagcaattggacggttgcatgcaggggaacttcagcgtggcttggaagtcaaggtttgtacacctgatgatgcttgcagggtcggcaaaataagtgagctttttgtttatcagaacttcagccgtgttccagttgaatctgttggtgccggtgacatttgtgctgtatgtggaatgaatgatatcatgattggggaaactattgctgataaagttacaggaacaccattgcccactatcaaagtggaggagccaacagtcagaatgtctttctccatcaatacatcaccttttgttggaaaggaggggaaatatgttactagccgaaatctccgtgacaggttatatcgtgagcttgaaaggaatttggctatgaaagtagaagatggggagactgctgatacattccttgttagtggaagaggcacactgcatctcacaatattgatagagaacatgcggagagaaggatatgaatttatgattggacctccaaaggtcataaacaagacagtggatggaaaacaactagaaccttatgagatagctgctgttgaggttccagaggagtacatgggttcagttgttgagcttttggggaaaaggcgtggacaaatggttaacatggaagctagcgggccggagggaacaacattgctgaaatacaagattcctaccagaggcctcattggacttcggaatgcaattcttacagcttctcgtggcagagctatacttaacacaatttttgacagctatggcccatgggctggagatcttagctcacgcgatcagggatccttggttgcgtttgaagatggaagcactacttcttacgcacttcttaatgcgcaagaaagaggtttgctgtttgtccaacctggccaggatgtttacaaaggtcaaattgttggtatccatcagcgacctggtgatttagcaattaatgtgtgcaagaaaaaggctgctacaaatgttcgttccaacaaggaaactacagtggttcttgatgaacctttaagctacagtttggatgactgcatagagtttatccaagaagatgagctagtggaggttacccctgcaagcatccgcatgtgcaagaacccaaaaatttcgaagagaaagtag

SEQ ID NO: 1046 - DNA, 957 bp, Setaria italica
atgcctccgactacgatggcttggacctccctcttcctccccaccaccgccggcgccaccgccgcggccaccggtagccgccacccctccttcagccaccgatcccactgccgcgttcccatgacgcgcctccgtcgcgcgccccggctcgtcgtttccgcttcagcctcaccggcctctcccgcgtcgtcgctcgacgcgctcatcttcgactgcgacggcgtcatactggagtcggagcacctccaccggcaggcctacaacgacgcgttcgcgcacttcggggtgcgctgcccgccggcctccgccgacccgctgtactgggacgaggccttctacgacgagctacagaaccgcatcggcggcgggaagcccaagatgcgatggtactttggggaaaatgggtggccttcttcaaatatcttcgagacaccaccttcgactgactccgataaggagaagttggtcgacataatccaggactggaaaacagagagatacaaagaaataataaaatctggaactgtggagcctagacctggtgttttgcggctgatggatgaagtaaagggtgcgggtatcaagcttgctgtttgctctgcagcaactaaaagttcagtgataatgtgccttgaaaaccttattggacttgagcgatttaagggcctggactgcttccttgcaggcgatgatgttaaactaaagaagcctgatccaacaatatatgttacagcagcagagaaattaggtgtgcaaagcaagaactgccttgtggtcgaggacagtgttattggattactagcggcaaaaggagcggggatgtcatgtataataacatatacaccttcaactgctagccaagatttcacggatgcaattgctacctatcctgaccttagtgatgtgaggctcgaggacctcaagctgttactccagaaaactcttgttactggatag

SEQ ID NO: 1047 - DNA, 1089 bp, Setaria italica
atggcacggtatcttctcgctcccaccaccaccgcctcctcctcctctgccctcctccccaaggatgccgccaagaacttgccgccgtcgcggaccctccgcctccgcgcgctcggctccaggtccggcaaggcgcgccccatcatggcggtagcgtcggagcaggcggccccggccgccggttaccccaaggtggccgcccccaccaccggcccgatccccgctgccgagctgctcggcgtcatcgaggccgccgcaaaagctggggccgatgttataatggaagctgttaataaaccacgcaatatccactataaaggtgttgcagacttggtgacagacacagataagttgagtgaatcagtaattttggaagttgtcatgaagaacttcaaaaaccacctcatacttggggaggaaggtggccttattggagattccttgtcagagtatctctggtgcattgaccctttagatggaacaacaaactttgcacatggttatccaagcttttctgtgtccattggggttctctttcgtggaaagcctgctgcttccacagtggtggaattttgtggtgggcctttttgctggagcacccgtacaatttctgcatctgctggtgggggagcttattgtaatgggcaaaaaattcatgttagtcaaacagacaaggtggagcaatctcttctcgtcacagggtttggatatgaacatgatgatgcctggacaaccaacattaatttgttcaaagagtttactgacattagcaggggagttcgaaggctagggtctgctgctgcggacatgtctcatgttggactgggcattacagaagcctactgggaataccggcttaagccatgggatatggctgctggtgtcctgatagttgaagaagctggtggggtggtaacacgcatggatggtggagcatttacagtcttcgaccgttctgttctggtctccaatggtgttgttcatggacagcttttggatcggattggccctcctactgaagatcttaagaagaaaggaattgatttctcgttgtggttcaagcccgacaagtacccaactgacttttga

SEQ ID NO: 1048 - DNA, 777 bp, Setaria italica
atggcggcttccgctctccatctccgcctcctcccctcgccgccagccggtgtgaagctccagcagcggcgcctccgctcgagaatactgaggcagggtggtctgtctcgtagatattcaaaagtagtgtgctattacgggctcacaactccaccatataaactggatgctttggaaccttatatgagcaggaggacagttgaacttcactggggtaagcaccatcatgattatgtggagggattaaataagcagcttgctaccagcccactgtatggatacactctggaggagctgataaaagaagcgtacaacaatggcaatccattaccagagtataacaatgcagcacaggtctggaaccatcacttcttctgggaatcaatgcaaccagaaggcggtggcttacctgagggaggtgtgttgcagcagattgaaaaggattttggctcgtttaccaatttcagggaagaatttattcgctcagccttacaacttttggggtctggttgggtttggcttgtcttgaagagaaatgagagaaagctttcagtagttcatacacgaaatgctatctccccacttgcttttggcgatattccaattatcagcctagatttatgggagcatgcttactacttagactacaaggatgatatgctaacatatgttacaaactttatggaccatctcatctcttgggacactgtcactctgcgcatgatgcgtgctgagtcgtttgtgaaccttaatgagccaaatattccagtggcatga

SEQ ID NO: 1049 - DNA, 1194 bp, Setaria italica
atggcgtcaactgttgccttcagctcagttagcgcgcaggctgggctgatccaaaagccaaggaaccatggtgtcacaagccactatggtttaaaggcatcatcatcatctgttagctttggatttgagtcgtcattcctgggcaggaatgcatccctccgtgcctctgtcgctccaaggattgtgccgaaggcgacgtctgggtctcagatatctccccaggcatcttacaaagtggctgtacttggtgctgccggtgggattggacaacccctaggccttttgatcaagatgtctcctctcgtgtcagagctgcatctgtacgatattgcaaatgtcaagggtgttgctgcggatctgagccattgcaattcacctgctcaggttctggacttcactggcccctcggaattggcaaactgcttgaaaggggtggatgttgttgtcatccctgccggagtcccaaggaagccgggcatgactcgtgatgacctctttaacatcaatgcaagcattgtcaagtcgcttgttgaggctgttgcggacaattgcccagacgcgttcatccatatcatcagcaacccagtgaactccacagtgccaattgctgctgaggttctgaagcagaagggtgtctataaccccaagaagctttttggagttaccaccctggatgttgtcagggccaacacatttgtggcacagaagaagaacctgaagctcattgatgttgacgtcccagttgtcggcggtcatgctgggattacaatattgccgttattgtccaagaccaggccatctgttaccttcacagaagaggaaactgaggagctgacaaagaggatacagaatgccgggacagaggtggtggaggccaaggctggtgcagggtctgctaccctgtccatggcctatgctgctgcccgttttgtcgagtcatctctccgtgcactggctggtgatccagatgtctatgagtgcacatttatccagtctgagcttactgatctgccattctttgcatcaagagtcaagctcgggaagaatggtgtcgaatctgtttccgctgacctcgagggagtgactgagtacgaggccaaggcgcttgaggcactgaaggctgagctgaagggaagcattgagaagggcatcgcgttcgcaaacaaacagcaggaagctgccgcgtctgtttga

SEQ ID NO: 1050 - DNA, 132 bp, Setaria italica
atggaagcggcggcgattgggtcgcagtccccgctctccttcccctccagcctctgcaaagcaaaagtatcctctggtttaccaatctgcaatgtgaaggtcaagaatcgcaggcttgaggtagtttgccat

SEQ ID NO: 1051 - DNA, 540 bp, Setaria italica
atgctcccaatggccgtccaccccgccaccacgccggccctcgccccgcgcgctcgcgtcgccccgcccagaccttccacctccttggccgccgcctcgtcctcctcctgctctcgcatcgtcggtgtcaagaccaggaggctgccccttcgctcgctccgcagcgtcgccgccgccgccgctgccgacgccgtcgaggaagaggaggtgcaactaggtggggctgcggatgcgttgtacgaggaggaagcagaggagtatgaggtgaaggtgcccgaaagacaggatcctatgctggtactgaagttcatctggatggagaagaacatcggcatagcacttgaccaattggttcccggctatggcagcatcccgttaagcccgtactacttttggccacggaaagatgcttgggaggagctgagagcgaaactggaggagaaagagtggatctcgcagaagcagatgatcattcttctcaaccaggccactgacatcatcaacctatggcagcagggtggcgggagcctgtcgacatga

SEQ ID NO: 1052 - DNA, 522 bp, Setaria italica
atggcccccaccgcgatggccgccacctccgtcgctccattccaggggctcaagtccaccgccggactccccgtcagccgccgctccaccagctccggcttcggcaacgtcagcaacggcgggaggatcaggtgcatgcaggtgtggccgattgggggcaagaagttcgagaccctctcctacctgccgcctctctcaaccgacgatctcctgaagcagatcgactacctgatccggaagaactggatcccttgcctcgagttcagcaaggttgggttcgtctaccgtgagaacaacaggtctcccggttactacgacggccgttactggaccatgtggaagctgcccatgttcggctgcaccgaggcaacccaggtgtacgctgagctcgaggagtgcaagaaggcctaccccgacgcctacatccgtatccttggcttcgacaacgtcaggcaggtgcagtgcatcatgttcatcgcctacaagcccccgggctgcgaggagaccggcgtcgccaaataa

SEQ ID NO: 1053 - DNA, 507 bp, Setaria italica
atggcgcccaccgtgatggccgccgccacctccgtcgctccattccaggggctcaagtccaccgccggactccccgtcagccgccgcatcagtcgcagcaccggcttcgtcagcaacggcggaaggatcaggtgcatgcaggtgtggccggcggagggcaacaagaagttcgagaccctctcctacctgccacctctctccacggacgaggtcctaaagcagatcgactacctgatccggaagaactggatcccctgcctcgagttcagcaagatcgggttcgtctatcgtgagaacagcacgtctccctgttactacgacgggcgctactggaccatgtggaagctgcccatgttcggctgcaccgaggccacccaggtgtacgctgagttcgaggagtgcaagaaggcctaccccgactgttacatccgtatcatcggcttcgacaacatcaagcaggtgcagtgcgtcatgttcatcgcctacaagcccccaggctccgagtag

SEQ ID NO: 1054 - DNA, 507 bp, Setaria italica
atggcgcccaccgtgatggcctcctcggccacctccgtggctccattccaggggctcaagtccaccgccggactccccgtcagccgccgcatcagtagcaccggcttcgtcagcaacggcggaaggatcaggtgcatgcaggtgtggccggcggagggcaacaagaagttcgagaccctctcctacctgccacctctctcaaccgaccagctcctgaagcaggtcgagtacctgatccggaacaactggatcccctgcctcgagttcagcaaggtcgggttcgtctttcgtgagaacagcaggtctccctgttactacgacgggcgctactggaccatgtggaagctgcccatgttcggctgcaccgaggccacccaggtgtacgctgagctcgaggagtgcaagaaggcctaccctgactgttacatccgtgtcatcggcttcgacaacctcaggcaggtgcaatgcgtcctgttcatcgcctacaagcccccgggcagcgagtag

SEQ ID NO: 1055 - DNA, 510 bp, Setaria italica
atggcgcccaccgtgatggcctcgtcggccacctcagttgctccattccaggggctcaagtccaccgccggactccccgtcagccgccgcatcagtcgcagcaccggcttcgtcagcaacggtggtaggattaggtgtatgcaggtgtggccggcggagggcaacaagaagttcgagaccctctcctacctgccacctctctccacggacgaggtcctgaagcagatcgactacctgatccggaagaactggatcccctgccttgagttcagcaagatcgggttcgtctatcgtgagaacagcacgtctccctgttactacgacgggcgctactggaccatgtggaagctgcccatgttcggctgcaccgaggccacccaggtgtacgctgagttcgaggagtgcaagaaggcctaccccgactgttacatccgtatcatcggcttcgacaacatgaagcaggtgcagtgcgtcatgttcatcgcctacaagcccccgggcagcgagtag

SEQ ID NO: 1056 - DNA, 1536 bp, Setaria italica
atggcggccatggcgtccagggccgccgcggccaccgcgtcgctcgacctcgccgccgcgccggccctctcgcgccgctgccaccgcccgacctcggcgcgcccatccgccgccgccgccgccgcccgcggactgcggatgcgcggggcggcgcgggtggtggtggcggccgcggcggcggcggcggcaccggcgaaggccggcgcggaggaggtcgtgctgcagcccatcagggagatctccggcaccgtcaagctgcccgggtccaagtcgctctccaaccggatcctcctgctctccgccctagccgaggggacgacagtggttgacaacctgctggatagtgaggatgtccactacatgcttggggccttgaaggccctcgggctctccgttgaagcagacaaagctgccaaaagagctgtagttgctggctgtggcggcaagttcccagttgagaaggacgccaaagaggaagtgcagctcttcttggggaatgctggaacagcgatgcggccgttgacagcagccgtgactgctgctggtggaaatgcaacttatgtgcttgatggagtaccgagaatgagggagagacccattggcgacttggttgtcggattgaaacagctgggtgcggatgttgattgtttccttggcactgactgcccacctgttcgtgtcaaggggattggagggctacctggtggcaaggttaagctatctggctccatcagcagtcaatacttgagtgccttgttgatggctgctcctttagctcttggggacgtggagattgaaatcattgataaactaatctccattccctacgtcgacatgacattgagattgatggagcgttttggcgtgaaagcagagcattctgataactgggacaggttctatatcaagggaggccaaaagtacaagtcccctaagaatgcatatgtggaaggcgatgcctcaagtgcaagctatttcttggctggtgctgcaattaccggagggactgtgactgttgaagggtgtggcaccaccagtttgcagggtgatgtgaaatttgctgaggtactggagaagatgggagcgaaggttacatggactgagactagtgtaactgttaccggtccaccacgggagccatttgggaggaaacacctaaaagccattgatgtcaacatgaacaaaatgcctgatgtcgccatgacccttgctgttgttgcgctctttgctgacggcccaaccgctattagagatgtggcttcctggagagtgaaggagactgagaggatggttgcgatccggactgagctcactaagctcggagcatcagttgaggaaggtccggactactgcatcatcacgccaccggagaagctgaacgtgacggcgatcgacacctacgacgaccacaggatggccatggccttctccctcgccgcctgcgccgaggtgcccgtcacgatcagggaccccgggtgcacccgcaagaccttccccgactacttcgatgttctgagcacgttcgtcaagaactga

SEQ ID NO: 1057 - DNA, 1158 bp, Setaria italica
atggaggccgtcctacgacatccatcgctgtcccgcctcaagcctccgaacccgaaccctcacaggacgccaccgccatccctcgcctccccttctctcctccgcctccgcgagcgccggctcaccgtcgccgcggtgttccaggaccagaaaccgagagagccagcgagcaaggggggcgacgacgaggaggcgtacggcgaggtggaccgcatcgtctccagccgcacgatcaagaacccggtgttcgcagaggacgggtcggccaccacgtccgtcgccacggagtacctcgtggagtggaaggacgggcacgagccatcctggatccccgcggaggccatcgacgcggacgtggtggccgagtacgagacgccgtggtggacggcggcgaagaaggcggacgcggaggcgctggcggcgctgctcgcggacgagacgctgcggcgggaccccgacgcggaggacgcgcaggggcgcaccgcggcgcacttcgccgcggggctggggtccgaggagtgcctgcgcgcgctcgccgcggccggggcggacttgggccaccgggagcgcgcggggggagggctcacgccgctgcacatcgcggtcgggtacggccgcgcgggcgccgtgcgcgcgctgctggagctgggcgcggacccggaggcccccgacgggcagggccgcacgccgctggagctggtccaggaggtgctcgccaggacgcccaagggcaacccggcggcgttccagctgcggcaggggcttgaggcggcgcagaaggagctggagaaggccgtgtacgagtgggccgaggtggagaaggtgatcgacggccgcggcgaaggcaagtggcgggagtacctggtggagtggcgcgacggcggcgagagggagtgggtgagggcgccgtgggtggcggaggacctggtgagcgacttcgaggccgggctggagtacgccgtggcggaggccgtggtggacaagaggccggcggcggcggagggcggagaggagaaatgggagtaccttgtcaagtgggtggacattgaggaggcgacgtgggagcctgccgagaacgtggacgacgagctcgtgcaggagtttgagctgaggcaatcaggatccgctggtggcgatggcagcgccactgctccatga

SEQ ID NO: 1058 - DNA, 1803 bp, Setaria italica
atggcggccgccgccaccgccgcagccgcctcggcctccttccccgcggccgccgccctctgccgcgacggccgccggccctcccgcgtgagcgccgcggcgacgacgcccgcggaggcggcggcgctcgctgccgtcccggcgccgatggtgcgggtggtgccggagtcgctgcagcgggagagcgggtgcctcgtggcggggttccgggagcgaggcgcgggcgcggcggatggggatgggttcggggacgcggcgcctgggggaggaggagggcccggcgcgatggagtacctcaccagcgtgctgtcgtccaaggtgtacgacgtggcaatcgagtcgccgctgcagctcgccaccaagctctccgaccgcctcggggtcaacctctggatcaagcgcgaggacctgcagccggtattctcattcaagctgcgtggggcatataatatgatggcaaagctctcccctgagcagttggagaggggcgtcatctgctcatctgctggaaaccatgcccagggagttgctctttccgctcagagactgggatgtgatgccgtcatcgtcatgccggtgacaacaccagaaatcaagtggaaatcagtggagaggttgggtgcaacggtagtcctcgagggggactcatacgatgaagctcagtcatatgcaaaattacgatgtgagcaggaaggtcgcacattcatacctccatttgaccatcctgatgttatcactggacaaggaactgtcggcatggaaattgttcggcaactgcaaggtccactgcatgcaatatttgtacctgtgggaggtggtggattaatcgctggaattgctgcttatgtgaaacgggttcgcccagaggtgaaaataatcggagtagaaccctcagatgcaaatgcaatggcattgtcattgtgtcatggcaagagggtcatgttagagcatgttggtggttttgcagatggtgtagctgtcaaaactgtaggggaggaaacatttcgcctgtgcagagaactagtagatggcatcgttatggtcagtcgagatgctatttgtgcttctataaaggatatgtttgaggagaaaagaagtatccttgaacctgctggtgcccttgcattggcaggggctgaagcctactgcaaatactataacttgaaaggagaaactgttgttgcaataactagtggagcaaatatgaactttgaccgacttagactagtaactgaacttgctgatgttggtcgaaaacgggaagcagtgctagctacatttctgccagaggagcagggaagcttcaaaagattcacggaattggttggccggatgaatattactgaatttaaatacagatacgattctaacgctaaagatgcccttgttctttacagcgttggcatttacactgacaatgagcttggagcaatggtggatcgcatggaatctgcaaaactgaggactgttaaccttactgacaatgatttggcgaaggaccatcttagatactttattggaggcagatcagaaataaaagatgaacttgtttaccggttcatttttccagaaaggcctggggccctcatgaaatttttggatgcattcagtccttgttggaatatcagccttttccattatcgtgcacagggtgaagctggagcaaatgtattagttggcatacaagtgccaccaaaagacttcgatgaattcaagagtcgtgctgagagtcttgggtacgagtacatgtcagagcacaacaatgagatataccgactgctgttgcgtgatccaaagatttaa

SEQ ID NO: 1059 - DNA, 2055 bp, Setaria italica
atgtcggaggccgaccgggtacgcctccgcgcggcggcgctggcgctgcaggacgatggggtaagggacaagccagacgccaaggcgaacgtcttcgcggatcttggctcgccggtgtcgccgctccgaccgcgggcgagcgtggcgacgtcgtcgtcctcgtcgtccgggtcggccaagtcgccggtgccgtcgaatgctgggatggcgggtgggaggaggcactccggcgagctgatggcggagtgcaacccgccacggatgacggggcaccggcggtgcggatctgggccgttgatattctccggcggcagcagcgggggaagcggcggcggcggcggggaccgtgggagcacggcgagctcgccgatgctgaatgcgctccccgccgggaacatctgttcgtccgggcgcgtcccggcggcggcggcggcgccgcctccgccgcgctcccgtccggacgtgctcggatccggcaccggccactacggccacgggagcatcatgcgcggcgcgggcatggcccccgccaggagcagcattgatgccccttcgttcctcgggcactcctcgaggtcgccggcgagctccccggcaagcggcggcggcgggagcctccaggaggtgacccgcttggggaacgagtggtacaagaagggcaagtacgcggaggcgctccgctactacgagcgcgccgtgtcgctttgccccgagagcgccgcgtgtcgcggcaaccgagccgccgcgctcataggacttggccggctcgccgacgcgctccgcgaatgcgaggaggccgtccggctcgacccggccagcggtcgcgcccacagccgcctcgccggcgtctgcctgcggttggggatgattgataaggcccggaggaacttcacccaggcaggtcatcttcagcagtctgatcccgctgagtggcagaagctgcaggaggtggagatgcatctgggaagaagcactgatgcacggaaaattggggattggaagagtgcactgagggaagctgatgctgccattgcctctggcgctgactcctctcagttgcttcttgccttgagatcagaagcactcctccgacttcacaagctggatgaggctgagtcgactcttgcaagtttgctgaaattggatggcacattgccctcatcattgacagcagcgaaactctcaggcatgctcgctgagtcctatgtacatattgtccgagcccaagttgacatggctttggggaggtttgatactgctgttgctgcagctgaaaaggctagagatcttgatcctgggaatgcagaagtggggatgattctgaataatgtgagactagttgcaaaagcccgagcccaaggaaatgatctctttaaggttggcaagttttcagatgcatcaatagcctatggtgaagggctcaagtatgatccctcaaattcagtgcttcactgcaatcgagctgcttgctggtcaaagctagaaaagtgggagaaagctgttgacgactgcaatgaggctctaagaatacaaccaaattatacaaaggctctcttaaggagggctgcgtcctacgctaagcttgagcgttgggctgattgcgtgcgggattatgaggtgcttcggaaagagcttcctagcgataaggaggttgcagaagctctgttccatgcccaaattgctttgaaggcgactcgtggtgaggatgtgtcaaatatgaagtttggaggagaggtagagatagtaaccaatgtagagcaactccatgctgccataggctcaccaggggtatctgttgtctacttcatgtcggcaatgaaccagcaatgcacacaaatcacaccttcggtgaacactctctgcactgaatgcccctcagtaaattttctgaaggtaaatgtcgacagcagccctctggtggcaaaggcagagaacgtgcggattgtcccgacattcaagatatacaaagacgggatgaaagtgaaggagatgatctgcccgactttacatgttctgcgctacaccgtgcgtcactattctgtatccagttcttga

SEQ ID NO: 1060 - DNA, 1818 bp, Setaria italica
atggcggctctggccacttcccagctcgtcaccacccgcgccggcttcggcctcggcgacgcctcctcctccatgttccgccccggcgtccagggcctcaggggctcccgggcctcctccccggcggccacgctcagcgtgcggaccagcgcgcgcgccgcgcccaggcagcagcaccgccgggcgcagcgcggcgccaggttcccctccctcgtcgtctgcgccaccgccggcatgaacgtcgtcttcgtcggcgccgagatggcgccttggagcaagaccggcggactcggcgacgtcctcggcggcctcccgccggccatggccgcgaatgggcaccgggtcatggtcatctccccccgctacgaccagtacaaggacgcctgggacaccagcgtcgtctccgagatcaaggtgggagacaggtacgagagggtgaggttcttccactgctacaagcgcggagtcgaccgcgtgttcatcgaccacccgtccttcctggagagggtttggggaaagactggtgagaagatctacgggccagacgctggagtggattacaaggacaaccagctgcgtttcagccttctttgccaggcagcacttgaagctcctaggattctgagcctcaacaacaacccttacttctcaggaccgtacggggaggacgtcgtgttcgtctgcaacgactggcacaccggccctctgtcgagctacctcaagagcaactaccagtccaacggcatctacagaaacgccaagaccgctttctgcatccacaacatctcctaccagggccggttcgcattctcggactacccggagctaaacctccctgagagattcagatcatccttcgatttcatcgacggctacgagaagcctgtggagggcaggaagatcaactggatgaaggccgggatcatcgaagccgacagggtcctgaccgtgagcccctactacgccgaggagctcatctccggcatcgccaggggctgcgagctcgacaacatcatgcgcctcaccggcatcaccggtatcgtcaacggcatggacgtcagcgagtgggaccccagcaaggacaagtacatcgccaccaagtacgacgtgtcaacggccattgcggccaaggcgctcaacaaggaggcgctgcaggccgcggccgggctcccggtggaccggaagatcccgctggtggcgttcgtcggcaggctggaggagcagaagggccccgacgtcatggctgccgccatcccgcagctcatggaggaggatgtccagatcgtccttctgggcactgggaagaagaagttcgagcgcatgctgatgagcgcggaggagaagtaccccgacaaggtgcgcgccgtggtgaagttcaacgcggcgctggcgcaccacatcatggccggcgccgacctgctcgccgtcaccagccgcttcgagccctgcggcctcatccagctgcaggggatgcgatacggcacgccctgcgtgtgcgcgtccaccggcgggctcgtcgacaccgtcatcgaaggcaagaccggattccacatgggccgcctcagcgtcgactgtaaggtcgtggagccggccgacgtgcagaaggtggcgagcaccctgaagcgcgccatcaaggtcgtcggcacgccggcgtacgaggagatggtcaggaactgcatgatccaggacctctcctggaagggccctgccaagaactgggagaacgttctgctgagcctgggcgtcgccggcagccagccggggatcgaaggcgaggagatcgcgccgctcgccaaggagaacgtggccgctccctga

SEQ ID NO: 1061 - protein, 977 aa, Setaria italica
MAAAPPLSADALSFLPSAAAPAAAAPTPVVAAAWGAARAAGSVRGKAALRMARRGSGLAPVVGRRPRRPPLSVRCDATSRDGRITQQEFTEMAWQSIVSSPEVAKESKHQIVETEHLVKSLLEQRNGLARRIFSKAGVDNTKLLDATEKFIQRQPKVLGEDPGSMLGRDLEALIQRARDFKKEYGDSYVSVEHLVLGFAEDKRFGKQLFKDFQITVKTLKLAIESIRGKQNVIDQDPEGKYEALEKYGKDLTAMARQGKLDPVIGRDDEIRRCIQILSRRTKNNPVLIGEPGVGKTAIAEGLAQRIVQGDVPQALTNRRLIALDMGALIAGAKYRGEFEDRLKAVLKEVTDSDGQTILFIDEIHTVVGAGATNGAMDAGNLLKPMLGRGELRCIGATTLDEYRKYIEKDPALERRFQQVYVDQPSVEDTISILRGLRERYELHHGVRISDSALVAAAVLSDRYISGRFLPDKAIDLVDESAAKLKMEITSKPTALDEIDRAVLKLEMERLSLTNDTDKASKGRRSRIEAELSLLKDKQRELTEQWEHEKSVMTKIQSIKEEIDRVNVEIQQAEREYDLNRAAELKYGSLNALQRQLQTTEKELDEYQSSGKSMLREEVTQDDIAEIVSRWTGIPVSKLKQSDREKLLYLEEELHKRVVGQDPAVKAVSEAIQRSRAGLSDPNRPIASFMFMGPTGVGKTELAKALAAFMFNTEEAVVRIDMSEYMEKHSVSRLIGAPPGYVGYEEGGQLTEAVRRRPYSVVLFDEIEKAHSDVFNVFLQILDDGRVTDSQGRKVSFTNTIIIMTSNVGSQYILNMDEEGGSSDSAYENIKKRVMDAARSVFRPEFMNRIDEYIVFKPLEREQINSIVKLQLARVQKRIADRKIKLEVSPAAIEFLGSLGYDPNYGARPVKRVIQQYVENELAKGILRGDFKDEDSIVVDTQVTVPSNGQLPQQKLVFRKVGEQSKAAAEDEKFLPAV

SEQ ID NO: 1062 - protein, 342 aa, Setaria italica
MADRLAAAAATFRASAVAAPSARRGARASRAFLPNSSASPAGARVGLRAAPSRLPQKARAVRCAAVAAASDAAQLKAAREDIRELLRTTHCHPILVRLGWHDAGTYDKNIEDWPQRGGANGSLRFDVELKHGANAGLINALKLIQPIKDKYPGITYADLFQLASATAIEEAGGPKIPMTYGRVDVTGPEQCPPEGKLPDAGPTSPADHLREVFYRMGLDDKDIVVLSGAHTLGRSRPERSGWGKPETKYTKNGPGAPGGQSWTPEWLKFDNSYFKEIKEKRDQDLLVLPTDAALFEDPAFKVYAEKYAADQDAFFKDYTESHAKLSNLGAKFNPPQGFSLDD

SEQ ID NO: 1063 - protein, 478 aa, Setaria italica
MAERLAASLLPAASPSPSARRATVAASGSAAASFPSSCSARAGLRLRSSRSGSARFSKAAGRGGGGGALRVVRCMAASDAAQLKSAREDIRELLKTTYCHPIMVRLGWHDSGTYDKNIEEWPQRGGADGSLRFEPELNHGANAGLINALKLIQPMKDKYPGITYADLFQLASATAIEEAGGPKIPMKYGRVDVTEPEQCPPEGRLPDAGPRDPAEHLREVFYRMGLDDKEIVALSGAHTLGRARPDRSGWGKPETKYTKDGPGEPGGQSWTVEWLKFDNSYFKDMKFLSQLPSKEQKDQDLLVLPTDAALFEDPSFKVYAEKYAEDQEAFFKDYAEAHAKLSDLGAKFDPPEGFSLDDDTSDEPAAEKKEEAAPTPEPAAAAAPPPEPAAAPALEPVAAAVATATADDNNGVAPQPEPFVAAKYSYGKTELSDSMKQKIRAEYEGFGGSPDKPLQSNYFLNIMLLIAGLAFLTSLVGN

SEQ ID NO: 1064 - protein, 311 aa, Setaria italica
MAVHHLLRRGVSGGFPLHPLRGLLASQELGRRPLSSAAGDAAAELRGAREDVKQLLKTTSCHPILVRLGWHDAGTYDKNIAEWPKCGGANGSLRFEIELKHGANAGLVNALKLIQPIKDKFSGVTYADLFQLASATAIEEAGGPKIPMIYGRVDITAPEQCPPEGRLPAAGPPSPAEHLREVFYRMGLNDKEIVALSGAHTLGRARPERSGWGKPETKYTKNGPGAPGGQSWTSQWLKFDNSYFKDVKERRDEDLLVLPTDAVLFEDSSFKVYAEKYAEDQDAFFKDYAEAHAKLSNLGAKFDPPKGISLE

SEQ ID NO: 1065 - protein, 603 aa, Setaria italica
MESLAAASVFSPSRVAAPAAGALVRAGAVVSAGMRRRSGRSGGMRCRAVTPLASAVMSRGAVAAKAAEEEKRRFFEAAARGSGKSNLVPMWECIVSDHLTPVLAYRCLVPEDNVDAPSFLFESVEQGPQGTTNVGRYSMVGAHPVMEIVAKEHKVTIMDHEKGQVTEQVVDDPMQVPRNMMEGWHPQQIDELPESFTGGWVGFFSYDTVRYVEKKKLPFSGAPQDDRNLPDVHLGLYDDVLVFDNVEKKVYVIHWVNVDRHASIEAAYQDGRSRLDQLLSKVHNSNVPTLSPGFVKLHTRQFGTPLNKSTMTSDEYKNAVMQAKEHIMAGDIFQIVLSQRFERRTYANPFEVYRALRIVNPSPYMAYVQARGCVLVASSPEILTRVSKGKIINRPLAGTVRRGKTEKEDQMQEQQLLSDEKQCAEHIMLVDLGRNDVGKVSKPGSVKVEKLMNIERYSHVMHISSTVSGQLDDRLQSWDALRAALPVGTVSGAPKVKAMELIDELEVTRRGPYSGGLGGISFDGNMQIALALRTIVFSTAPSHNTMYSYKAADRRREWVAHLQAGAGIVADSSPDDEQRECENKAAALARAIDLAESAFVDKE

SEQ ID NO: 1066 - protein, 246 aa, Setaria italica
MASLHLTGPRVAVAAKPAALGGLRLPTPSIAVPTGRRARGLVVRAATVVSPKYTSIKPLGDRVLVKVKTTEAKTDGGILLPVSVQSRPTGGEVVAVGEGRSFGSNSIEISVPVGAQVVYSKYAGTELEFNDADHLILKEDDIIGILDSDDVKDLKPLNDRILIKVAEAEEQTAGGLLLTQANKEKPSVGTVVAVGPGPLGEDGTRKALSITPGSNVMYSKYAGSEFKGQDGEYIVLRASDVMAVLS

SEQ ID NO: 1067 - protein, 273 aa, Setaria italica
MGALPVAHKLALTSPFLPRHRRPCPAAHHHGQRRRRHGVVVAYMEPNPNSPAAIAGRLVGALPVVGLVARILSDEGGVGGDIIDFAEFRRRVSKKCTVMDSQAFYDFNERRGKPGDPFYVLLCCWLAAVGAGLLKTEEILEGVARLRISNDIEFEEETFIDMIRTAKEKRAKLKAPAPQIPMETRAEKALEAIYVCCFGQDMVEEEDEKLLRTILNAVFPSVGRPAIERMVASMAKQVASGERKRDGRTVSKEVQQRQLKDLQFLKQNKLDSA

SEQ ID NO: 1068 - protein, 949 aa, Setaria italica
MEVCCCSTSSSSSVLTVGHGGAARMLAAPAGRWGAAAGFGRAMVLAHQLPLPHPLPRRASSSRPSPRRARRGLIMAVFERFTERAVKAVVLSQREARGLGEAAVAPRHLFLGLVAEDRSSGGYLSSGIGIERAREECRGIGARDVDAPPPPPPKTGSGLDTDVPFSAASKQVFEVAVVLSKNMGSSFISPEHLAIALFTLDDPTTNNLLRSLGADPSQLSSVAVDRLQAELAKDGRDPAGASSFKIPEKAPAAAGRSAFSQSLTKKKGKGALDQFCLDLTTQASGGFIDPIIGREEEIERVVQIICRRTKNNPILLGEAGVGKTAIAEGLALRIANGDVPIYLVAKRILSLDVGLLIAGAKERGELESRVTNIIREVREAGDVILFIDEVHNLIGSGTVGKGKGSSLDIGNLLKPALARGELQCIAATTLDEHRMHFEKDKALARRFQPVLVAEPSQEDAVKILLGLREKYETYHKCRFTLEAINAAVYLSARYIPDRQLPDKAIDLIDEAGSRARMESFNRKKEGQSSILLKSPDEYWQEIRAAQAMHEVVLSNKEKYSPNANDQESGNADVEAPYEDNRGSTSTSSLSADEPIVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLTDSQGRRVSFKNTLIVMTSNVGSTSISKGRRSIGFLKEDTESSSYVAMKSLVMEELKAFFRPELLNRIDEMVVFRPLEKTQMLAILDIILKEVKGRLLALGIGLEVSDAMKDLICQEGYDKSYGARPLRRAVTHMIEDVISEAILFGEFKPGNTILMDIDAEGKPCMSHLDQQIVQVTDPTRAF

SEQ ID NO: 1069 - protein, 297 aa, Setaria italica
MELRLCLRLHARLPPATTPPPPPFAAPAVLPASRRIRTGGSYGVALRRPTRRSNPAIRASEADGAPGVAVKERSVSVILLSGGQGKRMGASMPKQYLPLLGLPIALHSLKTFCQLKEMKEVVVVCDPDYSDVFEGSIENLQIPLKFACPGKERQDSVFNGLQEIDGDSELVCVHDSARPLVSSEDVKKVLQDAAVHGAAVLGVPVKATIKEANSDSFVVKTLDRKTLWEMQTPQVMKPDLLKAGFELVKRDGLEVTDDVSIVEYLKHPVYITEGSYTNIKVTTPDDMLLAERLMSGK

SEQ ID NO: 1070 - protein, 788 aa, Setaria italica
MAPALSGTLGASSVAALRPCAERRAPSAASSVAPRGSGAVRCPRGVRWEAERSRGRLVTVRCDAAVVEKPAGEEAAEEKFEYQAEVSRLMDLIVHSLYSHKEVFLRELVSNASDALDKLRFLGVTDSALLADGGELEIRIKPDPDAGTITITDTGVGMTKDELKDCLGTIAQSGTSKFLKALKENKDLGADNGLIGQFGVGFYSAFLVAEKVVVSTKSPKSDKQYVWEAVADSSSYVIKEETDPEKMLTRGTQITLFLRPDDKYEFADPSRIQGLVKNYSQFVSFPIYTWQEKSRTVEVEEDEEPKEGEEATEGEKLKKKKTITEKYWDWELANETKPIWMRNPKEIEKTEYNEFYKKTFNEFLDPLAHTHFTTEGEVEFRSVLYVPGMAPLSNDEIMNPKTKNIRLYVKRVFISDDFDGELFPRYLSFVKGVVDSNDLPLNVSREILQESRIVRIMRKRLVRKTFDMIEELAEKEDKEDYKKFWESFGKFIKLGCIEDTGNHKRLAPLLRFHSSKNEGDTISLDQYVENMPESQKAIYYIATDSLQSAKTAPFLEKLVQKDIEVLYLIEPIDEVAIQNLQTYKEKKFVDISKEDLELGDEEEENKETKQEFTLLCDWVKQQLGDKVAKVQISKRLSSSPCVLVSGKFGWSANMERLMKAQTLGDTSSLEFMRGRRIFEINPDHPIIKDLNAACKNEPESTEAKRAVELLYEAALISSGYTPESPAELGGKIYEMMAIALGGRWGRSDTEEAEASNDEASVGADASEGTVTEVIEPSEVRPESDPWRD

SEQ ID NO: 1071 - protein, 383 aa, Setaria italica
MISPPMPTHLLPTRTISPRSNGCAATASPSPPSMAARPRRLPSGLQSVTGRGKFSLAAITLDDYLPMRSTEVKNRTSTGDITSLRLITAVKTPYLPDGRFDLEAYDSLINMQIEGGAEGVIVGGTTGEGHLMSWDEHIMLIGHTVNCFGTRIKVIGNTGSNSTREAVHATEQGFAVGMHAALHINPYYGKTSIEGMISHFEAVLPMGPTIIYNVPSRTAQDIPPEVIMAISGYPNMAGVKECVGHERVKQYTDKDIAVWSGNDDECHDSRWKYGATGVISVASNLVPGLMHSLMYEGENATLNEKLLPLMKWLFCQPNPIALNTALAQLGVTRPVFRLPYVPLPLKKRIEFVRIVEAIGRQNFVGQKEARILDDDDFVLISRY

SEQ ID NO: 1072 - protein, 672 aa, Setaria italica
MQMQQTLTLRGVPSARRAAPPPASSAHLGSSPCLLRVPRSLRRRRPRSLRASASLEQEVKEVAASPAPSAGKSTQATRRDVRNIAIVAHVDHGKTTLVDSMLRQAKVFRDNQVVQERIMDSNDLERERGITILSKNTSITYKGTKINIIDTPGHSDFGGEVERVLNMVEGVLLVVDSVEGPMPQTRFVLKKALEFGHAVVVVVNKIDRPAARPEFVVNSTFELFIELNATDEQCDFQTVYASGIKGKAGLDPENLADDLGPLFEAILRCIPEPRIEKDGALQMLVSNTEYDEHKGRIAIGRLHAGELQRGLEVKVCTPDDACRVGKISELFVYQNFSRVPVESVGAGDICAVCGMNDIMIGETIADKVTGTPLPTIKVEEPTVRMSFSINTSPFVGKEGKYVTSRNLRDRLYRELERNLAMKVEDGETADTFLVSGRGTLHLTILIENMRREGYEFMIGPPKVINKTVDGKQLEPYEIAAVEVPEEYMGSVVELLGKRRGQMVNMEASGPEGTTLLKYKIPTRGLIGLRNAILTASRGRAILNTIFDSYGPWAGDLSSRDQGSLVAFEDGSTTSYALLNAQERGLLFVQPGQDVYKGQIVGIHQRPGDLAINVCKKKAATNVRSNKETTVVLDEPLSYSLDDCIEFIQEDELVEVTPASIRMCKNPKISKRK

SEQ ID NO: 1073 - protein, 318 aa, Setaria italica
MPPTTMAWTSLFLPTTAGATAAATGSRHPSFSHRSHCRVPMTRLRRAPRLVVSASASPASPASSLDALIFDCDGVILESEHLHRQAYNDAFAHFGVRCPPASADPLYWDEAFYDELQNRIGGGKPKMRWYFGENGWPSSNIFETPPSTDSDKEKLVDIIQDWKTERYKEIIKSGTVEPRPGVLRLMDEVKGAGIKLAVCSAATKSSVIMCLENLIGLERFKGLDCFLAGDDVKLKKPDPTIYVTAAEKLGVQSKNCLVVEDSVIGLLAAKGAGMSCIITYTPSTASQDFTDAIATYPDLSDVRLEDLKLLLQKTLVTG

SEQ ID NO: 1074 - protein, 362 aa, Setaria italica
MARYLLAPTTTASSSSALLPKDAAKNLPPSRTLRLRALGSRSGKARPIMAVASEQAAPAAGYPKVAAPTTGPIPAAELLGVIEAAAKAGADVIMEAVNKPRNIHYKGVADLVTDTDKLSESVILEVVMKNFKNHLILGEEGGLIGDSLSEYLWCIDPLDGTTNFAHGYPSFSVSIGVLFRGKPAASTVVEFCGGPFCWSTRTISASAGGGAYCNGQKIHVSQTDKVEQSLLVTGFGYEHDDAWTTNINLFKEFTDISRGVRRLGSAAADMSHVGLGITEAYWEYRLKPWDMAAGVLIVEEAGGVVTRMDGGAFTVFDRSVLVSNGVVHGQLLDRIGPPTEDLKKKGIDFSLWFKPDKYPTDF

SEQ ID NO: 1075 - protein, 258 aa, Setaria italica
MAASALHLRLLPSPPAGVKLQQRRLRSRILRQGGLSRRYSKVVCYYGLTTPPYKLDALEPYMSRRTVELHWGKHHHDYVEGLNKQLATSPLYGYTLEELIKEAYNNGNPLPEYNNAAQVWNHHFFWESMQPEGGGLPEGGVLQQIEKDFGSFTNFREEFIRSALQLLGSGWVWLVLKRNERKLSVVHTRNAISPLAFGDIPIISLDLWEHAYYLDYKDDMLTYVTNFMDHLISWDTVTLRMMRAESFVNLNEPNIPVA

SEQ ID NO: 1076 - protein, 397 aa, Setaria italica
MASTVAFSSVSAQAGLIQKPRNHGVTSHYGLKASSSSVSFGFESSFLGRNASLRASVAPRIVPKATSGSQISPQASYKVAVLGAAGGIGQPLGLLIKMSPLVSELHLYDIANVKGVAADLSHCNSPAQVLDFTGPSELANCLKGVDVVVIPAGVPRKPGMTRDDLFNINASIVKSLVEAVADNCPDAFIHIISNPVNSTVPIAAEVLKQKGVYNPKKLFGVTTLDVVRANTFVAQKKNLKLIDVDVPVVGGHAGITILPLLSKTRPSVTFTEEETEELTKRIQNAGTEVVEAKAGAGSATLSMAYAAARFVESSLRALAGDPDVYECTFIQSELTDLPFFASRVKLGKNGVESVSADLEGVTEYEAKALEALKAELKGSIEKGIAFANKQQEAAASV

SEQ ID NO: 1077 - protein, 44 aa, Setaria italica; identical to SEQ ID NO: 340

SEQ ID NO: 1078 - protein, 179 aa, Setaria italica
MLPMAVHPATTPALAPRARVAPPRPSTSLAAASSSSCSRIVGVKTRRLPLRSLRSVAAAAAADAVEEEEVQLGGAADALYEEEAEEYEVKVPERQDPMLVLKFIWMEKNIGIALDQLVPGYGSIPLSPYYFWPRKDAWEELRAKLEEKEWISQKQMIILLNQATDIINLWQQGGGSLST

SEQ ID NO: 1079 - protein, 173 aa, Setaria italica
MAPTAMAATSVAPFQGLKSTAGLPVSRRSTSSGFGNVSNGGRIRCMQVWPIGGKKFETLSYLPPLSTDDLLKQIDYLIRKNWIPCLEFSKVGFVYRENNRSPGYYDGRYWTMWKLPMFGCTEATQVYAELEECKKAYPDAYIRILGFDNVRQVQCIMFIAYKPPGCEETGVAK

SEQ ID NO: 1080 - protein, 168 aa, Setaria italica
MAPTVMAAATSVAPFQGLKSTAGLPVSRRISRSTGFVSNGGRIRCMQVWPAEGNKKFETLSYLPPLSTDEVLKQIDYLIRKNWIPCLEFSKIGFVYRENSTSPCYYDGRYWTMWKLPMFGCTEATQVYAEFEECKKAYPDCYIRIIGFDNIKQVQCVMFIAYKPPGSE

SEQ ID NO: 1081 - protein, 168 aa, Setaria italica
MAPTVMASSATSVAPFQGLKSTAGLPVSRRISSTGFVSNGGRIRCMQVWPAEGNKKFETLSYLPPLSTDQLLKQVEYLIRNNWIPCLEFSKVGFVFRENSRSPCYYDGRYWTMWKLPMFGCTEATQVYAELEECKKAYPDCYIRVIGFDNLRQVQCVLFIAYKPPGSE

SEQ ID NO: 1082 - protein, 169 aa, Setaria italica
MAPTVMASSATSVAPFQGLKSTAGLPVSRRISRSTGFVSNGGRIRCMQVWPAEGNKKFETLSYLPPLSTDEVLKQIDYLIRKNWIPCLEFSKIGFVYRENSTSPCYYDGRYWTMWKLPMFGCTEATQVYAEFEECKKAYPDCYIRIIGFDNMKQVQCVMFIAYKPPGSE

SEQ ID NO: 1083 - protein, 511 aa, Setaria italica
MAAMASRAAAATASLDLAAAPALSRRCHRPTSARPSAAAAAARGLRMRGAARVVVAAAAAAAAPAKAGAEEVVLQPIREISGTVKLPGSKSLSNRILLLSALAEGTTVVDNLLDSEDVHYMLGALKALGLSVEADKAAKRAVVAGCGGKFPVEKDAKEEVQLFLGNAGTAMRPLTAAVTAAGGNATYVLDGVPRMRERPIGDLVVGLKQLGADVDCFLGTDCPPVRVKGIGGLPGGKVKLSGSISSQYLSALLMAAPLALGDVEIEIIDKLISIPYVDMTLRLMERFGVKAEHSDNWDRFYIKGGQKYKSPKNAYVEGDASSASYFLAGAAITGGTVTVEGCGTTSLQGDVKFAEVLEKMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVTIRDPGCTRKTFPDYFDVLSTFVKN

SEQ ID NO: 1084 - protein, 385 aa, Setaria italica
MEAVLRHPSLSRLKPPNPNPHRTPPPSLASPSLLRLRERRLTVAAVFQDQKPREPASKGGDDEEAYGEVDRIVSSRTIKNPVFAEDGSATTSVATEYLVEWKDGHEPSWIPAEAIDADVVAEYETPWWTAAKKADAEALAALLADETLRRDPDAEDAQGRTAAHFAAGLGSEECLRALAAAGADLGHRERAGGGLTPLHIAVGYGRAGAVRALLELGADPEAPDGQGRTPLELVQEVLARTPKGNPAAFQLRQGLEAAQKELEKAVYEWAEVEKVIDGRGEGKWREYLVEWRDGGEREWVRAPWVAEDLVSDFEAGLEYAVAEAVVDKRPAAAEGGEEKWEYLVKWVDIEEATWEPAENVDDELVQEFELRQSGSAGGDGSATAP

SEQ ID NO: 1085 - protein, 600 aa, Setaria italica
MAAAATAAAASASFPAAAALCRDGRRPSRVSAAATTPAEAAALAAVPAPMVRVVPESLQRESGCLVAGFRERGAGAADGDGFGDAAPGGGGGPGAMEYLTSVLSSKVYDVAIESPLQLATKLSDRLGVNLWIKREDLQPVFSFKLRGAYNMMAKLSPEQLERGVICSSAGNHAQGVALSAQRLGCDAVIVMPVTTPEIKWKSVERLGATVVLEGDSYDEAQSYAKLRCEQEGRTFIPPFDHPDVITGQGTVGMEIVRQLQGPLHAIFVPVGGGGLIAGIAAYVKRVRPEVKIIGVEPSDANAMALSLCHGKRVMLEHVGGFADGVAVKTVGEETFRLCRELVDGIVMVSRDAICASIKDMFEEKRSILEPAGALALAGAEAYCKYYNLKGETVVAITSGANMNFDRLRLVTELADVGRKREAVLATFLPEEQGSFKRFTELVGRMNITEFKYRYDSNAKDALVLYSVGIYTDNELGAMVDRMESAKLRTVNLTDNDLAKDHLRYFIGGRSEIKDELVYRFIFPERPGALMKFLDAFSPCWNISLFHYRAQGEAGANVLVGIQVPPKDFDEFKSRAESLGYEYMSEHNNEIYRLLLRDPKI

SEQ ID NO: 1086 - protein, 684 aa, Setaria italica
MSEADRVRLRAAALALQDDGVRDKPDAKANVFADLGSPVSPLRPRASVATSSSSSSGSAKSPVPSNAGMAGGRRHSGELMAECNPPRMTGHRRCGSGPLIFSGGSSGGSGGGGGDRGSTASSPMLNALPAGNICSSGRVPAAAAAPPPPRSRPDVLGSGTGHYGHGSIMRGAGMAPARSSIDAPSFLGHSSRSPASSPASGGGGSLQEVTRLGNEWYKKGKYAEALRYYERAVSLCPESAACRGNRAAALIGLGRLADALRECEEAVRLDPASGRAHSRLAGVCLRLGMIDKARRNFTQAGHLQQSDPAEWQKLQEVEMHLGRSTDARKIGDWKSALREADAAIASGADSSQLLLALRSEALLRLHKLDEAESTLASLLKLDGTLPSSLTAAKLSGMLAESYVHIVRAQVDMALGRFDTAVAAAEKARDLDPGNAEVGMILNNVRLVAKARAQGNDLFKVGKFSDASIAYGEGLKYDPSNSVLHCNRAACWSKLEKWEKAVDDCNEALRIQPNYTKALLRRAASYAKLERWADCVRDYEVLRKELPSDKEVAEALFHAQIALKATRGEDVSNMKFGGEVEIVTNVEQLHAAIGSPGVSVVYFMSAMNQQCTQITPSVNTLCTECPSVNFLKVNVDSSPLVAKAENVRIVPTFKIYKDGMKVKEMICPTLHVLRYTVRHYSVSSS

SEQ ID NO: 1087 - protein, 605 aa, Setaria italica
MAALATSQLVTTRAGFGLGDASSSMFRPGVQGLRGSRASSPAATLSVRTSARAAPRQQHRRAQRGARFPSLVVCATAGMNVVFVGAEMAPWSKTGGLGDVLGGLPPAMAANGHRVMVISPRYDQYKDAWDTSVVSEIKVGDRYERVRFFHCYKRGVDRVFIDHPSFLERVWGKTGEKIYGPDAGVDYKDNQLRFSLLCQAALEAPRILSLNNNPYFSGPYGEDVVFVCNDWHTGPLSSYLKSNYQSNGIYRNAKTAFCIHNISYQGRFAFSDYPELNLPERFRSSFDFIDGYEKPVEGRKINWMKAGIIEADRVLTVSPYYAEELISGIARGCELDNIMRLTGITGIVNGMDVSEWDPSKDKYIATKYDVSTAIAAKALNKEALQAAAGLPVDRKIPLVAFVGRLEEQKGPDVMAAAIPQLMEEDVQIVLLGTGKKKFERMLMSAEEKYPDKVRAVVKFNAALAHHIMAGADLLAVTSRFEPCGLIQLQGMRYGTPCVCASTGGLVDTVIEGKTGFHMGRLSVDCKVVEPADVQKVASTLKRAIKVVGTPAYEEMVRNCMIQDLSWKGPAKNWENVLLSLGVAGSQPGIEGEEIAPLAKENVAAP

SEQ ID NO: 1088 - DNA, 253 bp, Agrobacterium tumefaciens
gatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 1089 - DNA, 300 bp, Oryza sativa
attaatcgatcctccgatcccttaattaccataccattacaccatgcatcaatatccatatatatataaaccctttcgcacgtacttatactatgttttgtcatacatatatatgtgtcgaacgatcgatctatcactgatatgatatgattgatccatcagcctgatctctgtatcttgttatttgtataccgtcaaataaaagtttcttccacttgtgttaataattagctactctcatctcatgaaccctatatataactagtttaatttgctgtcaattgaacatgatgatcgatg

SEQ ID NO: 1090 - DNA, 1812 bp, Artificial sequence
  misc_feature (1)..(1812): Codon redesigned sequence.
atggtccgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 1091 - DNA, 2001 bp, Artificial sequence
  misc_feature (1)..(2001): Codon redesigned sequence.
atggtccgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 1092 - DNA, 1812 bp, Artificial sequence
  misc_feature (1)..(1812): Codon redesigned sequence.
atggtccgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagctgcacgggaatatttcggcccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 1093 - DNA, 1528 bp, Oryza sativa
ggaagctaactagtcacggcgaatacatgacgacatcggcctacaacgcacaacttcttggcataaaagcttcaatttcaatgcccctatctggaagccctaggcgccgcgcaaatgtaaaacattcgcttcgcttggcttgttatccaaaatagagtatggacctccgacagattggcaacccgtgggtaatcgaaaatggctccatctgcccctttgtcgaaggaatcaggaaacggccctcacctcctggcggagtgtagatatgtgaaagaatctaggcgacacttgcagactggacaacatgtgaacaaataagaccaacgttatggcaacaagcctcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagccaaaattaaggaggatgccaaaacatgggtcttggcgggcgcgaaacaccttgataggtggcttaccttttaacatgttcgggccaaaggccttgagacggtaaagttttctatttgcgcttgcgcatgtacaattttattcctctattcaatgaaattggtggctcactggttcattaaaaaaaaaagaatctagcctgttcgggaagaagaggattttattcgtgagagagagagagagagagagagagagagggagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagctacgtgcctagtgtagattaaagttggcgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacggctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaacc

SEQ ID NO: 1094 - DNA, 99 bp, Oryza sativa
atctcaagcagcctaatcatctccagctgatcaagagctcttaattagctagctagtgattagctgcgcttgtgatcgatcgatctcgggtacgtagca

SEQ ID NO: 1095 - DNA, 614 bp, Cauliflower mosaic virus
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagg

SEQ ID NO: 1096 - DNA, 623 bp, Cauliflower mosaic virus
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctga

SEQ ID NO: 1097 - DNA, 9 bp, Cauliflower mosaic virus
acacgctga

SEQ ID NO: 1098 - DNA, 1399 bp, Oryza sativa
tcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaag

SEQ ID NO: 1099 - DNA, 841 bp, Oryza sativa
tcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccct

SEQ ID NO: 1100 - DNA, 80 bp, Oryza sativa
accaccaccaccaccaccacctccacctcctcccccctcgctgccggacgacgagctcctcccccctccccctccgccgc

SEQ ID NO: 1101 - DNA, 478 bp, Oryza sativa
cgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaag

SEQ ID NO: 1102 - DNA, 804 bp, Zea mays
accgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcgg

SEQ ID NO: 1103 - DNA, 906 bp, Artificial sequence
  misc_feature (1)..(906): Codon redesigned sequence.
atgggcaagggcgaggaactgttcactggcgtggtcccaatcctggtggaactggatggtgatgtgaacgggcacaagttctccgtcagcggagagggtgaaggtgatgccacctacggaaagctcaccctgaagttcatctgcactaccggaaagctccctgttccgtggccaaccctcgtcaccactttcacctacggtgttcagtgcttctcccggtacccagatcacatgaagcagcatgacttcttcaagagcgccatgcccgaaggctacgtgcaagaaaggactatctctttcaaggatgacgggaactacaagacacgtgccgaagtcaagttcgaaggtgataccctggtgaaccgcatcgagctgaaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcgatttcaaggaagatggaaacatcctcggacacaagctggagtacaactacaactcccacaacgtatacatcacggccgacaagcagaagaacggcatcaaggctaacttcaagatcaggcacaacatcgaagatggaagcgtgcaactggcggaccactaccagcagaacacgcccatcggcgatggccctgtcctgctgccggacaaccattacctgtccacgcaatctgccctctccaaggaccccaacgagaagagggaccacatggtcctgctggagttcgtgacggctgctgggatcacgcatggcatggatgaactctacaagtga

SEQ ID NO: 1104 - DNA, 1448 bp, Artificial sequence
  misc_feature (1)..(1448): Chimeric transcriptional regulatory element group.
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgacaagctgactctagcagatctaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcgg

SEQ ID NO: 1105 - DNA, 1204 bp, Artificial sequence
  misc_feature (1)..(1204): Chimeric transcriptional regulatory element.
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgacaagctgactctagcagatcctctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaag

SEQ ID NO: 1106 - DNA, 675 bp, Artificial sequence
  misc_feature (1)..(675): Chimeric transcriptional regulatory element.
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaaccatcttccacacactcaagccacactattggagaacacacagggacaacacaccataa

SEQ ID NO: 1107 - DNA, 2181 bp, Oryza sativa
gacaacaacatgcttctcatcaacatggagggaagagggagggagaaagtgtcgcctggtcacctccattgtcacactagccactggccagctctcccacaccaccaatgccaggggcgagctttagcacagccaccgcttcacctccaccaccgcactaccctagcttcgcccaacagccaccgtcaacgcctcctctccgtcaacataagagagagagagaagaggagagtagccatgtggggaggaggaatagtacatggggcctaccgtttggcaagttattttgggttgccaagttaggccaataaggggagggatttggccatccggttggaaaggttattggggtagtatctttttactagaattgtcaaaaaaaaatagtttgagagccatttggagaggatgttgcctgttagaggtgctcttaggacatcaaattccataaaaacatcagaaaaattctctcgatgaagatttataaccactaaaactgccctcaattcgaagggagttcaaaacaattaaaatcatgttcgaattgagtttcaatttcactttaacccctttgaaatctcaatggtaaaacatcaacccgtcaggtagcatggttctttttattcctttcaaaaagagttaattacaaacagaatcaaaactaacagttaggcccaaggcccatccgagcaaacaatagatcatgggccaggcctgccaccaccctccccctcctggctcccgctcttgaatttcaaaatccaaaaatatcggcacgactggccgccgacggagcgggcggaaaatgacggaacaacccctcgaattctaccccaactacgcccaccaacccacacgccactgacaatccggtcccacccttgtgggcccacctacaagcgagacgtcagtcgctcgcagcaaccagtgggcccacctcccagtgagcggcgggtagatctggactcttacccacccacactaaacaaaacggcatgaatattttgcactaaaaccctcagaaaaattccgatattccaaaccagtacagttcctgaccgttggaggagccaaagtggagcggagtgtaaaattgggaaacttaatcgagggggttaaacgcaaaaacgccgaggcgcctcccgctctatagaaaggggaggagtgggaggtggaaaccctaccacaccgcagagaaaggcgtcttcgtactcgcctctctccgcgccctcctccgccgccgctcgccgccgttcgtctccgccgccaccggctagccatccaggtaaaacaaacaaaaacggatctgatgcttccattcctccgtttctcgtagtagcgcgcttcgatctgtgggtggatctgggtgatcctggggtgtggttcgttctgtttgatagatctgtcggtggatctggccttctgtggttgtcgatgtccggatctgcgttttgatcagtggtagttcgtggatctggcgaaatgttttggatctggcagtgagacgctaagaatcgggaaatgatgcaatattaggggggtttcggatggggatccactgaattagtctgtctccctgctgataatctgttcctttttggtagatctggttagtgtatgtttgtttcggatagatctgatcaatgcttgtttgttttttcaaattttctacctaggttgtataggaatggcatgcggatctggttggattgccatgatccgtgctgaaatgcccctttggttgatggatcttgatattttactgctgttcacctagatttgtactcccgtttatacttaatttgttgcttattatgaatagatctgtaacttaggcacatgtatggacggagtatgtggatctgtagtatgtacattgctgcgagctaagaactatttcagagcaagcacagaaaaaaatatttagacagattgggcaactatttgatggtctttggtatcatgctttgtagtgctcgtttctgcgtagtaatcttttgatctgatctgaagataggtgctattatattcttaaaggtcattagaacgctatctgaaaggctgtattatgtggattggttcacctgtgactccctgttcgtcttgtcttgataaatcctgtgataaaaaaaattcttaaggcgtaatttgttgaaatcttgttttgtcctatgcagcctg

SEQ ID NO: 1108 - DNA, 210 bp, Triticum aestivum
ctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaatt

SEQ ID NO: 1109 - DNA, 1653 bp, Artificial sequence
  misc_feature (1)..(1653): Codon redesigned DNA sequence.
atggaagacgccaaaaacataaagaaaggcccggcgccattctatcctctagaggatggaaccgctggagagcaactgcataaggctatgaagagatacgccctggttcctggaacaattgcttttacagatgcacatatcgaggtgaacatcacgtacgcggaatacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgaacatttcgcagcctaccgtagtgtttgtttccaaaaaggggttgcaaaaaattttgaacgtgcaaaaaaaattaccaataatccagaaaattattatcatggattctaaaacggattaccagggatttcagtcgatgtacacgttcgtcacatctcatctacctcccggttttaatgaatacgattttgtaccagagtcctttgatcgtgacaaaacaattgcactgataatgaattcctctggatctactgggttacctaagggtgtggcccttccgcatagaactgcctgcgtcagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttttacgatcccttcaggattacaaaattcaaagtgcgttgctagtaccaaccctattttcattcttcgccaaaagcactctgattgacaaatacgatttatctaatttacacgaaattgcttctgggggcgcacctctttcgaaagaagtcggggaagcggttgcaaaacgcttccatcttccagggatacgacaaggatatgggctcactgagactacatcagctattctgattacacccgagggggatgataaaccgggcgcggtcggtaaagttgttccattttttgaagcgaaggttgtggatctggataccgggaaaacgctgggcgttaatcagagaggcgaattatgtgtcagaggacctatgattatgtccggttatgtaaacaatccggaagcgaccaacgccttgattgacaaggatggatggctacattctggagacatagcttactgggacgaagacgaacacttcttcatagttgaccgcttgaagtctttaattaaatacaaaggatatcaggtggcccccgctgaattggaatcgatattgttacaacaccccaacatcttcgacgcgggcgtggcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagtccaaattgtaa

SEQ ID NO: 1110 - DNA, 936 bp, Artificial sequence
  misc_feature (1)..(936): Codon redesigned coding sequence.
atggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaa

SEQ ID NO: 1111 - DNA, 8 bp, Cauliflower mosaic virus
acacgctg

SEQ ID NO: 1112 - DNA, 612 bp, Cauliflower mosaic virus
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagg

SEQ ID NO: 1113 - DNA, 480 bp, Oryza sativa
ccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaag

SEQ ID NO: 1114 - DNA, 61 bp, Triticum aestivum
aaccatcttccacacactcaagccacactattggagaacacacagggacaacacaccataa

SEQ ID NO: 1115 - DNA, 993 bp, Figwort mosaic virus
aattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattagcttgagctcaggatttagcagcattccagattgggttcaatcaacaaggtacgagccatatcactttattcaaattggtatcgccaaaaccaagaaggaactcccatcctcaaaggtttgtaaggaagaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattccctctatataagaaggcattcattcccatttgaaggatcatcagatac

SEQ ID NO: 1116 - DNA, 522 bp, Cauliflower mosaic virus
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgat

SEQ ID NO: 1117 - DNA, 608 bp, Cauliflower mosaic virus
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatctagacgcaagacccttcctctatataaggaagttcatttcatttggagagga

The invention claimed is:

1. A DNA molecule comprising a DNA sequence selected from the group consisting of:
   a) a sequence with at least 99 percent sequence identity to the full length of SEQ ID NO: 272 and having transcription termination activity; and
   b) a sequence comprising SEQ ID NO: 272;
   wherein said sequence is operably linked to a heterologous transcribable polynucleotide molecule.

2. The DNA molecule of claim 1, wherein the heterologous transcribable polynucleotide molecule comprises a gene of agronomic interest.

3. The DNA molecule of claim 1, wherein the heterologous transcribable polynucleotide molecule comprises a gene capable of providing herbicide resistance in plants.

4. The DNA molecule of claim 1, wherein the transcribable polynucleotide molecule comprises a gene capable of providing plant pest control in plants.

5. A transgenic plant cell comprising a DNA construct comprising a sequence selected from the group consisting of:
   a) a sequence with at least 99 percent sequence identity to the full length of SEQ ID NO: 272 and having transcription termination activity; and
   b) a sequence comprising SEQ ID NO: 272;
   wherein said sequence is operably linked to a heterologous transcribable polynucleotide molecule.

6. The transgenic plant cell of claim 5, wherein said transgenic plant cell is a monocotyledonous plant cell.

7. The transgenic plant cell of claim 5, wherein said transgenic plant cell is a dicotyledonous plant cell.

8. A transgenic plant, or part thereof, comprising the DNA molecule of claim 1.

9. A progeny plant of the transgenic plant of claim 8, or a part thereof, wherein the progeny plant or part thereof comprises said DNA molecule.

10. A transgenic seed, wherein the seed comprises the DNA molecule of claim 1.

* * * * *